US012406749B2

(12) United States Patent
Shen et al.

(10) Patent No.: US 12,406,749 B2
(45) Date of Patent: Sep. 2, 2025

(54) SYSTEMS AND METHODS FOR PREDICTING REPAIR OUTCOMES IN GENETIC ENGINEERING

(71) Applicants: The Broad Institute, Inc., Cambridge, MA (US); Massachusetts Institute of Technology, Cambridge, MA (US); The Brigham and Women's Hospital, Inc., Boston, MA (US); President and Fellows of Harvard College, Cambridge, MA (US)

(72) Inventors: Max Walt Shen, Cambridge, MA (US); Jonathan Yee-Ting Hsu, Cambridge, MA (US); Mandana Arbab, Cambridge, MA (US); David K. Gifford, Cambridge, MA (US); David R. Liu, Cambridge, MA (US); Richard Irving Sherwood, Cambridge, MA (US)

(73) Assignees: The Broad Institute, Inc., Cambridge, MA (US); Massachusetts Institute of Technology, Cambridge, MA (US); The Brigham and Women's Hospital, Inc., Boston, MA (US); President and Fellows of Harvard College, Cambridge, MA (US)

( * ) Notice: Subject to any disclaimer, the term of this patent is extended or adjusted under 35 U.S.C. 154(b) by 351 days.

(21) Appl. No.: 16/772,747

(22) PCT Filed: Dec. 15, 2018

(86) PCT No.: PCT/US2018/065886
§ 371 (c)(1),
(2) Date: Jun. 12, 2020

(87) PCT Pub. No.: WO2019/118949
PCT Pub. Date: Jun. 20, 2019

(65) Prior Publication Data
US 2022/0238182 A1 Jul. 28, 2022

Related U.S. Application Data

(60) Provisional application No. 62/669,771, filed on May 10, 2018, provisional application No. 62/599,623, filed on Dec. 15, 2017.

(51) Int. Cl.
| | |
|---|---|
| *G16B 20/30* | (2019.01) |
| *A61K 31/7088* | (2006.01) |
| *A61K 38/46* | (2006.01) |
| *C12N 9/22* | (2006.01) |
| *C12N 15/10* | (2006.01) |
| *C12N 15/11* | (2006.01) |
| *G16B 40/20* | (2019.01) |

(52) U.S. Cl.
CPC .......... *G16B 20/30* (2019.02); *A61K 31/7088* (2013.01); *A61K 38/465* (2013.01); *C12N 9/22* (2013.01); *C12N 15/1089* (2013.01); *C12N 15/11* (2013.01); *G16B 40/20* (2019.02); *C12N 2310/20* (2017.05); *C12N 2800/80* (2013.01)

(58) Field of Classification Search
None
See application file for complete search history.

(56) References Cited

U.S. PATENT DOCUMENTS

| | | | |
|---|---|---|---|
| 4,182,449 A | 1/1980 | Kozlow | |
| 4,186,183 A | 1/1980 | Steck et al. | |
| 4,217,344 A | 8/1980 | Vanlerberghe et al. | |
| 4,235,871 A | 11/1980 | Papahadjopoulos et al. | |
| 4,261,975 A | 4/1981 | Fullerton et al. | |
| 4,485,054 A | 11/1984 | Mezei et al. | |
| 4,501,728 A | 2/1985 | Geho et al. | |
| 4,663,290 A | 5/1987 | Weis et al. | |
| 4,737,323 A | 4/1988 | Martin et al. | |
| 4,774,085 A | 9/1988 | Fidler | |
| 4,797,368 A | 1/1989 | Carter et al. | |

(Continued)

FOREIGN PATENT DOCUMENTS

| | | |
|---|---|---|
| AU | 2012244264 A1 | 11/2012 |
| AU | 2015252023 A1 | 11/2015 |

(Continued)

OTHER PUBLICATIONS

Kuan, P.F., Powers, S., He, S. et al. A systematic evaluation of nucleotide properties for CRISPR sgRNA design. BMC Bioinformatics 18, 297 (2017) (Year: 2017).*
Ousterout et al. Multiplex CRISPR/Cas9-based genome editing for correction of dystrophin mutations that cause Duchenne muscular dystrophy. Nat Commun 6, 6244 (2015) (Year: 2015).*
Seonwoo Min, Byunghan Lee, Sungroh Yoon, Deep learning in bioinformatics, Briefings in Bioinformatics, vol. 18, Issue 5, Sep. 2017, pp. 851-869 (Year: 2017).*
Qiuyu Zhu et al. Novel Thrombotic Function of a Human SNP in STXBP5 Revealed by CRISPR/Cas9 Gene Editing in Mice. Arteriosclerosis, Thrombosis, and Vascular Biology. vol. 37, No. 2, 2017 pp. 264-270 (Year: 2017).*

(Continued)

*Primary Examiner* — Olivia M. Wise
*Assistant Examiner* — Jonathan Edward Hayes
(74) *Attorney, Agent, or Firm* — Wolf, Greenfield & Sacks, P.C.

(57) ABSTRACT

The specification provides methods for introducing a desired genetic change in a nucleotide sequence using a double-strand break (DSB)-inducing genome editing system, the method comprising: identifying one or more available cut sites in a nucleotide sequence; analyzing the nucleotide sequence and available cut sites with a computational model to identify the optimal cut site for introducing the desired genetic change into the nucleotide sequence; and contacting the nucleotide sequence with a DSB-inducing genome editing system, thereby introducing the desired genetic change in the nucleotide sequence at the cut site.

13 Claims, 72 Drawing Sheets

Specification includes a Sequence Listing.

(56) References Cited

U.S. PATENT DOCUMENTS

| | | |
|---|---|---|
| 4,837,028 A | 6/1989 | Allen |
| 4,873,316 A | 10/1989 | Meade et al. |
| 4,880,635 A | 11/1989 | Janoff et al. |
| 4,889,818 A | 12/1989 | Gelfand et al. |
| 4,897,355 A | 1/1990 | Eppstein et al. |
| 4,906,477 A | 3/1990 | Kurono et al. |
| 4,911,928 A | 3/1990 | Wallach |
| 4,917,951 A | 4/1990 | Wallach |
| 4,920,016 A | 4/1990 | Allen et al. |
| 4,921,757 A | 5/1990 | Wheatley et al. |
| 4,946,787 A | 8/1990 | Eppstein et al. |
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,844,075 A | 12/1998 | Kawakami et al. |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,962,313 A | 10/1999 | Podsakoff et al. |
| 5,981,182 A | 11/1999 | Jacobs, Jr. et al. |
| 6,015,794 A | 1/2000 | Haseloff et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,558,671 B1 | 5/2003 | Slingluff et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case et al. |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,067,650 B1 | 6/2006 | Tanaka |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,419,669 B2 | 9/2008 | Kosmatopoulos et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,488,718 B2 | 2/2009 | Scheinberg et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 7,999,071 B2 | 8/2011 | Schlom et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,354,380 B2 | 1/2013 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,439 B2 | 4/2014 | Mangeot et al. |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,835,148 B2 | 9/2014 | Janulaitis et al. |
| 8,846,578 B2 | 9/2014 | McCray et al. |
| 8,871,445 B2 | 10/2014 | Cong et al. |
| 8,889,418 B2 | 11/2014 | Zhang et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,023,649 B2 | 5/2015 | Mali et al. |
| 9,034,650 B2 | 5/2015 | Padidam |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |

(56) References Cited

U.S. PATENT DOCUMENTS

| | | |
|---|---|---|
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,290,773 B2 | 3/2016 | Edgerton |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,784 B2 | 12/2016 | Liu et al. |
| 9,534,210 B2 | 1/2017 | Park et al. |
| 9,580,698 B1 | 2/2017 | Xu et al. |
| 9,610,322 B2 | 4/2017 | Liu et al. |
| 9,637,739 B2 | 5/2017 | Siksnys et al. |
| 9,663,770 B2 | 5/2017 | Rogers et al. |
| 9,695,446 B2 | 7/2017 | Mangeot et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,914,939 B2 | 3/2018 | Church et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,474 B2 | 9/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,583,201 B2 | 3/2020 | Chen et al. |
| 10,597,679 B2 | 3/2020 | Liu et al. |
| 10,612,011 B2 | 4/2020 | Liu et al. |
| 10,640,767 B2 | 5/2020 | Maianti et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,214,780 B2 | 1/2022 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,319,532 B2 | 5/2022 | Liu et al. |
| 11,447,770 B1 | 9/2022 | Liu et al. |
| 11,542,496 B2 | 1/2023 | Liu et al. |
| 11,542,509 B2 | 1/2023 | Maianti et al. |
| 11,560,566 B2 | 1/2023 | Liu et al. |
| 11,578,343 B2 | 2/2023 | Liu et al. |
| 11,643,652 B2 | 5/2023 | Liu et al. |
| 11,661,590 B2 | 5/2023 | Liu et al. |
| 11,702,651 B2 | 7/2023 | Liu et al. |
| 11,732,274 B2 | 8/2023 | Liu et al. |
| 11,795,443 B2 | 10/2023 | Liu et al. |
| 11,795,452 B2 | 10/2023 | Liu et al. |
| 11,820,969 B2 | 11/2023 | Maianti et al. |
| 11,898,179 B2 | 2/2024 | Maianti et al. |
| 11,912,985 B2 | 2/2024 | Liu et al. |
| 11,920,181 B2 | 3/2024 | Liu et al. |
| 11,932,884 B2 | 3/2024 | Liu et al. |
| 11,999,947 B2 | 6/2024 | Liu et al. |
| 12,006,520 B2 | 6/2024 | Liu et al. |
| 12,031,126 B2 | 7/2024 | Liu et al. |
| 12,043,852 B2 | 7/2024 | Liu et al. |
| 12,084,663 B2 | 9/2024 | Maianti et al. |
| 12,157,760 B2 | 12/2024 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0156861 A1 | 8/2004 | Figdor et al. |
| 2004/0197892 A1 | 10/2004 | Moore et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0015238 A1 | 1/2007 | Snyder et al. |
| 2007/0049533 A1 | 3/2007 | Liu et al. |
| 2007/0264692 A1 | 11/2007 | Liu et al. |
| 2007/0269817 A1 | 11/2007 | Shapero |
| 2008/0008697 A1 | 1/2008 | Mintier et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2008/0241917 A1 | 10/2008 | Akita et al. |
| 2008/0268516 A1 | 10/2008 | Perreault et al. |
| 2009/0111119 A1 | 4/2009 | Doyon et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |

(56) References Cited

U.S. PATENT DOCUMENTS

| | | |
|---|---|---|
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0022980 A1 | 1/2013 | Nelson et al. |
| 2013/0059931 A1 | 3/2013 | Petersen-Mahrt et al. |
| 2013/0108657 A1 | 5/2013 | Yee et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0212725 A1 | 8/2013 | Kuhn et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0128449 A1 | 5/2014 | Liu et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0128300 A1 | 5/2015 | Warming et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0241440 A1 | 8/2015 | Fasan et al. |
| 2015/0252358 A1 | 9/2015 | Maeder et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340661 A1 | 11/2016 | Cong et al. |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0022251 A1 | 1/2017 | Rammensee et al. |
| 2017/0037432 A1 | 2/2017 | Donohoue et al. |

(56) References Cited

U.S. PATENT DOCUMENTS

| | | |
|---|---|---|
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211061 A1 | 7/2017 | Weiss et al. |
| 2017/0224843 A1 | 8/2017 | Deglon et al. |
| 2017/0226522 A1 | 8/2017 | Hu et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1 | 9/2017 | Barrangou et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0037877 A1 | 2/2018 | Gao et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0258418 A1 | 9/2018 | Kim |
| 2018/0265864 A1 | 9/2018 | Li et al. |
| 2018/0273935 A1 | 9/2018 | Lane et al. |
| 2018/0273939 A1 | 9/2018 | Yu et al. |
| 2018/0273976 A1 | 9/2018 | Ümit et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0346927 A1 | 12/2018 | Doudna et al. |
| 2018/0371497 A1 | 12/2018 | Gill et al. |
| 2019/0010481 A1 | 1/2019 | Joung et al. |
| 2019/0032053 A1 | 1/2019 | Ji et al. |
| 2019/0055543 A1 | 2/2019 | Tran et al. |
| 2019/0055549 A1* | 2/2019 | Capurso .............. C12N 15/102 |
| 2019/0062734 A1 | 2/2019 | Cotta-Ramusino et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0309290 A1 | 10/2019 | Neuteboom et al. |
| 2019/0322992 A1 | 10/2019 | Liu et al. |
| 2019/0330619 A1 | 10/2019 | Smith et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0056206 A1 | 2/2020 | Tremblay et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0157570 A1 | 5/2020 | Loiler |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0318116 A1 | 10/2020 | Freier |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0249697 A1 | 8/2022 | Liu et al. |
| 2022/0282275 A1 | 9/2022 | Liu et al. |
| 2022/0290115 A1 | 9/2022 | Liu et al. |
| 2022/0307001 A1 | 9/2022 | Liu et al. |
| 2022/0307003 A1 | 9/2022 | Liu et al. |
| 2022/0315906 A1 | 10/2022 | Liu et al. |
| 2022/0356469 A1 | 11/2022 | Liu et al. |
| 2022/0380740 A1 | 12/2022 | Liu et al. |
| 2022/0389395 A1 | 12/2022 | Liu et al. |
| 2023/0002745 A1 | 1/2023 | Liu et al. |
| 2023/0021641 A1 | 1/2023 | Liu et al. |
| 2023/0056852 A1 | 2/2023 | Liu et al. |
| 2023/0058176 A1 | 2/2023 | Liu et al. |
| 2023/0078265 A1 | 3/2023 | Liu et al. |

(56) References Cited

U.S. PATENT DOCUMENTS

| | | |
|---|---|---|
| 2023/0086199 A1 | 3/2023 | Liu et al. |
| 2023/0090221 A1 | 3/2023 | Liu et al. |
| 2023/0108687 A1 | 4/2023 | Liu et al. |
| 2023/0123669 A1 | 4/2023 | Liu et al. |
| 2023/0127008 A1 | 4/2023 | Liu et al. |
| 2023/0159913 A1 | 5/2023 | Liu et al. |
| 2023/0193295 A1 | 6/2023 | Maianti et al. |
| 2023/0220374 A1 | 7/2023 | Liu et al. |
| 2023/0272425 A1 | 8/2023 | Liu et al. |
| 2023/0279443 A1 | 9/2023 | Liu et al. |
| 2023/0332144 A1 | 10/2023 | Liu et al. |
| 2023/0340465 A1 | 10/2023 | Liu et al. |
| 2023/0340466 A1 | 10/2023 | Liu et al. |
| 2023/0340467 A1 | 10/2023 | Liu et al. |
| 2023/0348883 A1 | 11/2023 | Liu et al. |
| 2023/0357766 A1 | 11/2023 | Liu et al. |
| 2023/0383289 A1 | 11/2023 | Liu et al. |
| 2024/0035017 A1 | 2/2024 | Liu et al. |
| 2024/0076652 A1 | 3/2024 | Liu et al. |
| 2024/0110166 A1 | 4/2024 | Maianti et al. |
| 2024/0124866 A1 | 4/2024 | Liu et al. |
| 2024/0173430 A1 | 5/2024 | Liu et al. |
| 2024/0209329 A1 | 6/2024 | Liu et al. |
| 2024/0229077 A1 | 7/2024 | Liu et al. |
| 2024/0271116 A1 | 8/2024 | Maianti et al. |
| 2024/0287487 A1 | 8/2024 | Liu et al. |
| 2024/0327872 A1 | 10/2024 | Liu et al. |

FOREIGN PATENT DOCUMENTS

| | | |
|---|---|---|
| AU | 2015101792 A4 | 1/2016 |
| AU | 2012354062 B2 | 9/2017 |
| BR | 112015013786 A2 | 7/2017 |
| CA | 2480696 A1 | 10/2003 |
| CA | 2894668 A1 | 6/2014 |
| CA | 2894681 A1 | 6/2014 |
| CA | 2894684 A1 | 6/2014 |
| CA | 2852593 A1 | 11/2015 |
| CN | 1069962 A | 3/1993 |
| CN | 101460619 A | 6/2009 |
| CN | 101873862 A | 10/2010 |
| CN | 102057039 A | 5/2011 |
| CN | 102892777 A | 1/2013 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103088008 A | 8/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 9/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805118 A | 7/2015 |
| CN | 104846010 A | 8/2015 |
| CN | 104805078 A | 9/2015 |
| CN | 104805099 A | 9/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |

(56) References Cited

FOREIGN PATENT DOCUMENTS

| | | | |
|---|---|---|---|
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105934516 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106103475 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106232823 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |

(56) References Cited

FOREIGN PATENT DOCUMENTS

| | | |
|---|---|---|
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108243575 A | 7/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 U | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108472314 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |

(56) References Cited

FOREIGN PATENT DOCUMENTS

| | | |
|---|---|---|
| CN | 108513575 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108699542 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 208034188 U | 11/2018 |
| CN | 109517841 A | 3/2019 |
| EP | 0264166 A1 | 4/1988 |
| EP | 0321201 B2 | 6/1989 |
| EP | 0519463 A1 | 12/1992 |
| EP | 1085892 A2 | 3/2001 |
| EP | 1092770 A2 | 4/2001 |
| EP | 2604255 A1 | 6/2013 |
| EP | 2840140 A1 | 2/2015 |
| EP | 2877490 A2 | 6/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3115457 A | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 2498823 B1 | 8/2018 |
| EP | 3365437 A1 | 8/2018 |
| EP | 3450553 B1 | 12/2019 |
| ES | 2740248 T3 | 2/2020 |
| GB | 2528177 A | 1/2016 |
| GB | 2531454 A | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |
| JP | 2016-525888 A | 9/2016 |
| JP | 2016-534132 A | 11/2016 |
| JP | 2017-500035 A | 1/2017 |
| JP | 2018-521045 A | 8/2018 |
| JP | 2019-506123 A | 2/2019 |
| JP | 6629734 B2 | 1/2020 |
| JP | 6633524 B2 | 1/2020 |
| JP | 6830517 B2 | 2/2021 |
| JP | 7324523 B2 | 8/2023 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 Y | 10/2017 |
| SG | 10201710486X | 1/2018 |
| SG | 10201710487 | 1/2018 |
| SG | 10201710488 T | 1/2018 |
| TW | I608100 B | 12/2017 |
| TW | 201809272 A | 3/2018 |
| TW | 2018-29773 A | 8/2018 |
| WO | WO 1990/002809 | 3/1990 |
| WO | WO 1991/003162 A1 | 3/1991 |
| WO | WO 1991/016024 A1 | 10/1991 |
| WO | WO 1991/017271 A1 | 11/1991 |
| WO | WO 1991/017424 A1 | 11/1991 |
| WO | WO 1992/006188 A2 | 4/1992 |
| WO | WO 1992/006200 A1 | 4/1992 |
| WO | WO 1992/007065 A1 | 4/1992 |
| WO | WO 1993/015187 A1 | 8/1993 |
| WO | WO 1993/024641 A2 | 12/1993 |
| WO | WO 1994/018316 A2 | 8/1994 |
| WO | WO 1994/026877 A1 | 11/1994 |
| WO | WO 1996/004403 A1 | 2/1996 |
| WO | WO 1996/010640 A1 | 4/1996 |
| WO | WO 1998/032845 A1 | 7/1998 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2003/004608 A2 | 1/2003 |
| WO | WO 2004/007684 A2 | 1/2004 |
| WO | WO 2005/014791 A2 | 2/2005 |
| WO | WO 2005/019415 A2 | 3/2005 |
| WO | WO 2006/002547 A1 | 1/2006 |
| WO | WO 2006/042112 A2 | 4/2006 |
| WO | WO 2007/025097 A2 | 3/2007 |
| WO | WO 2007/037444 A1 | 4/2007 |
| WO | WO 2007/066923 A1 | 6/2007 |
| WO | WO 2007/136815 A2 | 11/2007 |
| WO | WO 2007/143574 A1 | 12/2007 |

(56) References Cited

FOREIGN PATENT DOCUMENTS

| | | |
|---|---|---|
| WO | WO 2008/005529 A2 | 1/2008 |
| WO | WO 2008/108989 A2 | 9/2008 |
| WO | WO 2009/002418 A2 | 12/2008 |
| WO | WO 2009/019317 A1 | 2/2009 |
| WO | WO 2009/098290 A1 | 8/2009 |
| WO | WO 2009/134808 A2 | 11/2009 |
| WO | WO 2010/011961 A2 | 1/2010 |
| WO | WO 2010/012902 A1 | 2/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/091122 A1 | 8/2010 |
| WO | WO 2010/102257 A2 | 9/2010 |
| WO | WO 2010/104749 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A2 | 5/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/061815 A2 | 5/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A1 | 12/2012 |
| WO | WO 2013/012674 A1 | 1/2013 |
| WO | WO 2013/013105 A1 | 1/2013 |
| WO | WO 2013/039857 A1 | 3/2013 |
| WO | WO 2013/039861 A2 | 3/2013 |
| WO | WO 2013/040093 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/120022 A2 | 8/2013 |
| WO | WO 2013/122617 A1 | 8/2013 |
| WO | WO 2013/126794 A1 | 8/2013 |
| WO | WO 2013/130683 A2 | 9/2013 |
| WO | WO 2013/130824 A1 | 9/2013 |
| WO | WO 2013/141680 A1 | 9/2013 |
| WO | WO 2013/142578 A1 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A1 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |

(56) References Cited

FOREIGN PATENT DOCUMENTS

| | | |
|---|---|---|
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | 2015/021990 A1 | 2/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A1 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042393 A2 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |
| WO | WO 2015/052133 A1 | 4/2015 |
| WO | WO 2015/052231 A1 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A1 | 6/2015 |
| WO | WO 2015/095804 A1 | 6/2015 |
| WO | WO 2015/099850 A1 | 7/2015 |
| WO | WO 2015/100929 A1 | 7/2015 |

(56) References Cited

FOREIGN PATENT DOCUMENTS

| | | |
|---|---|---|
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148760 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A1 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/035918 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |

(56) References Cited

FOREIGN PATENT DOCUMENTS

| | | |
|---|---|---|
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A1 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A2 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164305 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |

(56) References Cited

FOREIGN PATENT DOCUMENTS

| | | |
|---|---|---|
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017054721 A1 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |

(56) References Cited

FOREIGN PATENT DOCUMENTS

| | | |
|---|---|---|
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142923 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165741 A1 | 9/2017 |
| WO | WO 2017/165826 A1 | 9/2017 |
| WO | WO 2017/165862 A1 | 9/2017 |
| WO | WO 2017/167712 A1 | 10/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A1 | 10/2017 |
| WO | WO 2017/182468 A1 | 10/2017 |
| WO | WO 2017/182585 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |

(56) References Cited

FOREIGN PATENT DOCUMENTS

| | | |
|---|---|---|
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A2 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A2 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/161032 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2018/226855 A1 | 12/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/042284 A1 | 3/2019 |
| WO | WO 2019/051097 A1 | 3/2019 |
| WO | WO 2019/075357 A1 | 4/2019 |
| WO | WO 2019/079347 A1 | 4/2019 |
| WO | WO 2019/084062 A1 | 5/2019 |
| WO | WO 2019/090169 A1 | 5/2019 |
| WO | WO 2019/090367 A1 | 5/2019 |
| WO | WO 2019/092042 A1 | 5/2019 |
| WO | WO 2019/118935 A1 | 6/2019 |
| WO | WO 2019/118949 A1 | 6/2019 |
| WO | WO 2019/123430 A1 | 6/2019 |
| WO | WO 2019/126709 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/161251 A1 | 8/2019 |
| WO | WO 2019/168953 A1 | 9/2019 |
| WO | WO 2019/183641 A1 | 9/2019 |
| WO | WO 2019/204369 A1 | 10/2019 |
| WO | WO 2019/217942 A1 | 11/2019 |
| WO | WO 2019/226593 A1 | 11/2019 |
| WO | WO 2019/226953 A1 | 11/2019 |
| WO | WO 2019/236566 A1 | 12/2019 |
| WO | WO 2019/241649 A1 | 12/2019 |
| WO | WO 2020/014261 A1 | 1/2020 |
| WO | WO 2020/028555 A2 | 2/2020 |
| WO | WO 2020/028823 A1 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/081568 A1 | 4/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/102709 A1 | 5/2020 |

(56) References Cited

FOREIGN PATENT DOCUMENTS

| WO | WO 2020/154500 A1 | 7/2020 |
|---|---|---|
| WO | WO 2020/157008 A1 | 8/2020 |
| WO | WO 2020/160071 A1 | 8/2020 |
| WO | WO 2020/160481 A1 | 8/2020 |
| WO | WO 2020/160517 A1 | 8/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A2 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/205681 A1 | 10/2020 |
| WO | WO 2020/210751 A1 | 10/2020 |
| WO | WO 2020/214842 A1 | 10/2020 |
| WO | WO 2020/236982 A1 | 11/2020 |
| WO | WO 2020/247587 A1 | 12/2020 |
| WO | WO 2021/025750 A1 | 2/2021 |
| WO | WO 2021/030666 A1 | 2/2021 |
| WO | WO 2021/072328 A1 | 4/2021 |
| WO | WO 2021/108717 A2 | 6/2021 |
| WO | WO 2021/138469 A1 | 7/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/222318 A1 | 11/2021 |
| WO | WO 2021/226558 A1 | 11/2021 |
| WO | WO 2022/067130 A2 | 3/2022 |
| WO | WO 2022/150790 A2 | 7/2022 |
| WO | WO 2023/015309 A2 | 2/2023 |

OTHER PUBLICATIONS

Ran FA, Cong L, Yan WX, Scott DA, Gootenberg JS, Kriz AJ, Zetsche B, Shalem O, Wu X, Makarova KS, Koonin EV, Sharp PA, Zhang F. In vivo genome editing using *Staphylococcus aureus* Cas9. Nature. Apr. 9, 2015;520(7546):186-91. (Year: 2015) .*
Fu et al. Chapter Two—Targeted Genome Editing in Human Cells Using CRISPR/Cas Nucleases and Truncated Guide RNAs Methods in Enzymology, Academic Press, vol. 546, 2014, pp. 21-45. (Year: 2014).*
Svitashev et al, Targeted Mutagenesis, Precise Gene Editing, and Site-Specific Gene Insertion in Maize Using Cas9 and Guide RNA, Plant Physiology, vol. 169, Issue 2, Oct. 2015, pp. 931-945 (Year: 2015).*
Hendel, A., Bak, R., Clark, J. et al. Chemically modified guide RNAs enhance CRISPR-Cas genome editing in human primary cells. Nat Biotechnol 33, 985-989 (2015) (Year: 2015).*
Fu et al. Improving CRISPR-Cas nuclease specificity using truncated guide RNAs. Nat Biotechnol 32, 279-284 (2014) (Year: 2014).*
Hwang WY, Fu Y, Reyon D, Maeder ML, Kaini P, et al. (2013) Heritable and Precise Zebrafish Genome Editing Using a CRISPR-Cas System. PLOS One 8(7): e68708. (Year: 2013).*
Courtney, D., Moore, J., Atkinson, S. et al. CRISPR/Cas9 DNA cleavage at SNP-derived PAM enables both in vitro and in vivo KRT12 mutation-specific targeting Gene Ther 23, 108-112 (2016) (Year: 2016).*
Shin, H., Wang, C., Lee, H. et al. CRISPR/Cas9 targeting events cause complex deletions and insertions at 17 sites in the mouse genome. Nat Commun 8, 15464 (2017) (Year: 2017).*

Ousterout DG, Kabadi AM, Thakore PI, Majoros WH, Reddy TE, Gersbach CA. Multiplex CRISPR/Cas9-based genome editing for correction of dystrophin mutations that cause Duchenne muscular dystrophy. Nat Commun. Feb. 18, 2015;6:6244. (Year: 2015).*
Zhang Y, Long C, Li H, McAnally JR, Baskin KK, Shelton JM, Bassel-Duby R, Olson EN. CRISPR-Cpf1 correction of muscular dystrophy mutations in human cardiomyocytes and mice. Sci Adv. Apr. 12, 2017;3(4):e1602814. (Year: 2017).*
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 62/288,661, filed Jan. 29, 2016, Muir et al.
U.S. Appl. No. 62/357,332, filed Jun. 30, 2016, Liu et al.
[No Author Listed] NCBI Accession No. XP_015843220.1. C ->U editing enzyme APOBEC-1 [Peromyscus maniculatus bairdii], XP002793540. Mar. 21, 2016.
[No Author Listed] NCBI Accession No. XP_021505673.1. C ->U editing enzyme APOBEC-1 [Meriones unguiculatus], XP002793541. Jun. 27, 2017.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.

(56) References Cited

OTHER PUBLICATIONS

Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.

Aihara et al., A conformational switch controls the DNA cleavage activity of lambda integrase. Mol Cell. Jul. 2003;12(1):187-98.

Aik et al., Structure of human RNA ?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.

Aird et al., Increasing Cas9-mediated homology-directed repair efficiency through covalent tethering of DNA repair template. Commun Biol. May 31, 2018;1:54. doi: 10.1038/s42003-018-0054-2.

Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.

Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.

Akinsheye et al., Fetal hemoglobin in sickle cell anemia. Blood. Jul. 7, 2011;118(1):19-27. doi: 10.1182/blood-2011-03-325258. Epub Apr. 13, 2011.

Akopian et al., Chimeric recombinases with designed DNA sequence recognition. Proc Natl Acad Sci U S A. Jul. 22, 2003;100(15):8688-91. Epub Jul. 1, 2003.

Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.

Alarcón et al., N6-methyladenosine marks primary microRNAs for processing. Nature. Mar. 26, 2015;519(7544):482-5. doi: 10.1038/nature14281. Epub Mar. 18, 2015.

Alexander, HFE-associated hereditary hemochromatosis. Genet Med. May 2009;11(5):307-13. doi: 10.1097/GIM.0b013e31819d30f2.

Alexandrov et al., Signatures of mutational processes in human cancer. Nature. Aug. 22, 2013;500(7463):415-21. doi: 10.1038/nature12477. Epub Aug. 14, 2013.

Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.

Altschul et al., Basic local alignment search tool. J Mol Biol. Oct. 5, 1990;215(3):403-10. doi: 10.1016/S0022-2836(05)80360-2.

Amato et al., Interpreting elevated fetal hemoglobin in pathology and health at the basic laboratory level: new and known Y-gene mutations associated with hereditary persistence of fetal hemoglobin. Int J Lab Hematol. Feb. 2014;36(1):13-9. doi: 10.1111/ijlh.12094. Epub Apr. 29, 2013.

Ames et al., A eubacterial riboswitch class that senses the coenzyme tetrahydrofolate. Chem Biol. Jul. 30, 2010;17(7):681-5. doi: 10.1016/j.chembiol.2010.05.020.

Anders et al., Chapter One: In Vitro Enzymology of Cas9. in Methods in Enzymology, eds Doudna et al. 2014: 546:1-20.

Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.

Anderson, Human gene therapy. Science. May 8, 1992;256(5058):808-13. doi: 10.1126/science.1589762.

André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.

Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.

Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.

Anzalone et al., Search-and-replace genome editing without double-strand breaks or donor DNA. Nature. Dec. 2019;576(7785):149-157. doi: 10.1038/s41586-019-1711-4. Epub Oct. 21, 2019.

Aplan, Causes of oncogenic chromosomal translocation. Trends Genet. Jan. 2006;22(1):46-55. doi: 10.1016/j.tig.2005.10.002. Epub Oct. 28, 2005.

Araki et al., Comparative analysis of right element mutant lox sites on recombination efficiency in embryonic stem cells. BMC Biotechnol. Mar. 31, 2010;10:29. doi: 10.1186/1472-6750-10-29.

Araki et al., Site-specific recombinase, R, encoded by yeast plasmid pSR1. J Mol Biol. May 5, 1992;225(1):25-37. doi: 10.1016/0022-2836(92)91023-i.

Araki et al., Targeted integration of DNA using mutant lox sites in embryonic stem cells. Nucleic Acids Res. Feb. 15, 1997;25(4):868-72. doi: 10.1093/nar/25.4.868.

Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.

Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.

Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.

Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.

Arnold et al., Mutants of Tn3 resolvase which do not require accessory binding sites for recombination activity. EMBO J. Mar. 1, 1999;18(5):1407-14.

Asante et al., A naturally occurring variant of the human prion protein completely prevents prion disease. Nature. Jun. 25, 2015;522(7557):478-81. doi: 10.1038/nature14510. Epub Jun. 10, 2015.

Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.

Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.

Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.

Badran et al., Continuous evolution of Bacillus thuringiensis toxins overcomes insect resistance. Nature. May 5, 2016;533(7601):58-63. doi: 10.1038/nature17938. Epub Apr. 27, 2016.

Badran et al., Development of potent in vivo mutagenesis plasmids with broad mutational spectra. Nat Commun. Oct. 7, 2015;6:8425. doi: 10.1038/ncomms9425.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.

(56) References Cited

OTHER PUBLICATIONS

Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi: 10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barmania et al., C-C chemokine receptor type five (CCR5): An emerging target for the control of HIV infection. Appl Transl Genom. May 26, 2013;2:3-16. doi: 10.1016/j.atg.2013.05.004.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an-terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011; 19(12):2186-200. doi: 10.1038/mt.2011.190. Epub Oct. 4, 2011.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Behr, Gene transfer with synthetic cationic amphiphiles: prospects for gene therapy. Bioconjug Chem. Sep.-Oct. 1994;5(5):382-9. doi: 10.1021/bc00029a002.

Bell et al., Ribozyme-catalyzed excision of targeted sequences from within RNAs. Biochemistry. Dec. 24, 2002;41(51):15327-33. doi: 10.1021/bi0267386.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, HCN channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Bentin, T., A ribozyme transcribed by a ribozyme. Artif DNA PNA XNA. Apr. 2011;2(2):40-42. doi: 10.4161/adna.2.2.16852.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review
Bertolotti et al., Toward genosafe endonuclease-boosted gene targeting using breakthrough CRISP/Cas9 for next generation stem cell gene therapy culminating in efficient ex vivo in vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 2, 20196;10(1):1937. doi: 10.1038/s41467-019-09987-0.
Beumer et al., Efficient gene targeting in *Drosophila* with zinc-finger nucleases. Genetics. Apr. 2006; 172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Billon et al., CRISPR-Mediated Base Editing Enables Efficient Disruption of Eukaryotic Genes through Induction of Stop Codons. Mol Cell. Sep. 21, 2017;67(6): 1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 2, 20053;435(7045):1059-66. doi: 10.1038/nature03657.

(56) References Cited

OTHER PUBLICATIONS

Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast *Torulaspora delbrueckii*. Plasmid. 1997;38(3):202-9. doi: 10.1006/plas.1997.1315.
Blau et al., A proliferation switch for genetically modified cells. PNAS Apr. 1, 1997 94 (7)3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p. 5. http://cen.acs.org/articles/94/i17/Improved-route-single-base-genome.html.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611860310001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013; 1010:3-17. doi: 10.1007/978-1-62703-411-1_1.
Bulow et al., Multienzyme systems obtained by gene fusion. Trends Biotechnol. Jul. 1991;9(7):226-31.
Burke et al., Activating mutations of Tn3 resolvase marking interfaces important in recombination catalysis and its regulation. Mol Microbiol. Feb. 2004;51(4):937-48.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003; 10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.

(56) References Cited

OTHER PUBLICATIONS

Cai et al., Reconstruction of ancestral protein sequences and its applications. BMC Evol Biol. Sep. 17, 2004;4:33. doi: 10.1186/1471-2148-4-33.

Calame et al., Transcriptional controlling elements in the immunoglobulin and T cell receptor loci. Adv Immunol. 1988;43:235-75. doi: 10.1016/s0065-2776(08)60367-3.

Caldecott et al., Single-strand break repair and genetic disease. Nat Rev Genet. Aug. 2008;9(8):619-31. doi: 10.1038/nrg2380.

Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.

Cameron, Recent advances in transgenic technology. Mol Biotechnol. Jun. 1997;7(3):253-65.

Camper et al., Postnatal repression of the alpha-fetoprotein gene is enhancer independent. Genes Dev. Apr. 1989;3(4):537-46. doi: 10.1101/gad.3.4.537.

Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

Canver et al., Customizing the genome as therapy for the ?-hemoglobinopathies. Blood. May 26, 2016;127(21):2536-45. doi: 10.1182/blood-2016-01-678128. Epub Apr. 6, 2016.

Cargill et al., Characterization of single-nucleotide polymorphisms in coding regions of human genes. Nat Genet. Jul. 1999;22(3):231-8.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Caron et al., Intracellular delivery of a Tat-eGFP fusion protein into muscle cells. Mol Ther. Mar. 2001;3(3):310-8.

Carr et al., Genome engineering. Nat Biotechnol. Dec. 2009;27(12):1151-62. doi: 10.1038/nbt.1590.

Carroll et al., Gene targeting in *Drosophila* and Caenorhabditis elegans with zinc-finger nucleases. Methods Mol Biol. 2008;435:63-77. doi: 10.1007/978-1-59745-232-8_5.

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

Carroll, A CRISPR approach to gene targeting. Mol Ther. Sep. 2012;20(9):1658-60. doi: 10.1038/mt.2012.171.

Carroll, Genome engineering with zinc-finger nucleases. Genetics. Aug. 2011;188(4):773-82. doi: 10.1534/genetics.111.131433. Review.

Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.

Caspi et al., Distribution of split DnaE inteins in cyanobacteria. Mol Microbiol. Dec. 2003;50(5):1569-77. doi: 10.1046/j.1365-2958.2003.03825.x.

Cattaneo et al., SEL1L affects human pancreatic cancer cell cycle and invasiveness through modulation of PTEN and genes related to cell-matrix interactions. Neoplasia. 2005;7(11):1030-1038.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chan et al., Novel selection methods for DNA-encoded chemical libraries. Curr Opin Chem Biol. 2015;26:55-61. doi:10.1016/j.cbpa.2015.02.010.

Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.

Chapman et al., Playing the end game: DNA double-strand break repair pathway choice. Mol Cell. Aug. 24, 2012;47(4):497-510. doi: 10.1016/j.molcel.2012.07.029.

Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.

Charpentier et al., Biotechnology: Rewriting a genome. Nature. Mar. 7, 2013;495(7439):50-1. doi: 10.1038/495050a.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.

Chavez et al., Therapeutic applications of the ?C31 integrase system. Curr Gene Ther. Oct. 2011;11(5):375-81. Review.

Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Enhanced proofreading governs CRISPR-Cas9 targeting accuracy. Nature. Oct. 19, 2017;550(7676):407-410. doi: 10.1038/nature24268. Epub Sep. 20, 2017.

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.

Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.

Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.

Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.

(56) References Cited

OTHER PUBLICATIONS

Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.

Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.

Chesnoy et al., Structure and function of lipid-DNA complexes for gene delivery. Annu Rev Biophys Biomol Struct. 2000;29:27-47.

Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chew et al., A multifunctional AAV-CRISPR-Cas9 and its host response. Nat Methods. Oct. 2016; 13(10):868-74. doi: 10.1038/nmeth.3993. Epub Sep. 5, 2016. Supplementary Information.

Chichili et al., Linkers in the structural biology of protein-protein interactions. Protein Science. 2013;22:153-67.

Chin, Expanding and reprogramming the genetic code of cells and animals. Annu Rev Biochem. 2014;83:379-408. doi: 10.1146/annurev-biochem-060713-035737. Epub Feb. 10, 2014.

Chipev et al., A leucine—proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Site-specific recombination of bacteriophage P22 does not require integration host factor. J Bacteriol. Jul. 1999;181(14):4245-9. doi: 10.1128/JB.181.14.4245-4249.1999.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Cho et al., The calcium-activated chloride channel anoctamin 1 acts as a heat sensor in nociceptive neurons. Nat Neurosci. May 27, 2012;15(7):1015-21. doi: 10.1038/nn.3111.

Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.

Choi et al., (6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.

Choi et al., Protein trans-splicing and characterization of a split family B-type DNA polymerase from the hyperthermophilic archaeal parasite *Nanoarchaeum equitans*. J Mol Biol. Mar. 10, 2006;356(5):1093-106. doi: 10.1016/j.jmb.2005.12.036. Epub Dec. 27, 2005.

Choi et at al., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.

Chong et al., Modulation of protein splicing of the *Saccharomyces cerevisiae* vacuolar membrane ATPase intein. J Biol Chem. Apr. 24, 1998;273(17): 10567-77. doi: 10.1074/jbc.273.17.10567.

Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.

Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.

Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.

Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.

Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.

Choudhury et al., Engineering RNA endonucleases with customized sequence specificities. Nat Commun. 2012;3:1147. doi: 10.1038/ncomms2154.

Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.

Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christiansen et al., Characterization of the lactococcal temperate phage TP901-1 and its site-specific integration. J Bacteriol. Feb. 1994;176(4):1069-76. doi: 10.1128/jb.176.4.1069-1076.1994.

Chuai et al., DeepCRISPR: optimized CRISPR guide RNA design by deep learning. Genome Biol. Jun. 26, 2018;19(1):80. doi: 10.1186/s13059-018-1459-4.

Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.

Chuang et al., Novel Heterotypic Rox Sites for Combinatorial Dre Recombination Strategies. G3 (Bethesda). Dec. 29, 2015;6(3):559-71. doi: 10.1534/g3.115.025841.

Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.

Clackson et al., Redesigning an FKBP-ligand interface to generate chemical dimerizers with novel specificity. Proc Natl Acad Sci U S A. Sep. 1, 1998;95(18): 10437-42. doi: 10.1073/pnas.95.18.10437.

Clement et al., CRISPResso2 provides accurate and rapid genome editing sequence analysis. Nat Biotechnol. Mar. 2019;37(3):224-226. doi: 10.1038/s41587-019-0032-3.

Cobb et al., Directed evolution as a powerful synthetic biology tool. Methods. Mar. 15, 2013;60(1):81-90. doi: 10.1016/j.ymeth.2012.03.009. Epub Mar. 23, 2012.

Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.

Cokol et al., Finding nuclear localization signals. EMBO Rep. Nov. 2000;1(5):411-5. doi: 10.1093/embo-reports/kvd092.

Cole et al., Reconstructing evolutionary adaptive paths for protein engineering. Methods Mol Biol. 2013;978:115-25. doi: 10.1007/978-1-62703-293-3_8.

Cole-Strauss et al., Correction of the mutation responsible for sickle cell anemia by an RNA-DNA oligonucleotide. Science. Sep. 6, 1996;273(5280):1386-9.

Collinge, Prion diseases of humans and animals: their causes and molecular basis. Annu Rev Neurosci. 2001;24:519-50. doi: 10.1146/annurev.neuro.24.1.519.

(56) References Cited

OTHER PUBLICATIONS

Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI: 10.2174/1389450117011512171109l7.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Crystal, Transfer of genes to humans: early lessons and obstacles to success. Science. Oct. 20, 1995;270(5235):404-10. doi: 10.1126/science.270.5235.404.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.

Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
Database EBI Accession No. ADE34233 Jan. 29, 2004.
Database EBI Accession No. BFF09785. May 3, 20181. 2 pages.
Database EBI Accession No. BGE38086. Jul. 2, 20195. 2 pages.
Database UniProt Accession No. G8I3E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, Alive Study. Science. Sep. 27, 1996;273(5283):1856-62. doi: 10.1126/science.273.5283.1856.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., Experimental interrogation of the path dependence and stochasticity of protein evolution using phage-assisted continuous evolution. Proc Natl Acad Sci USA. May 2013;110(22):9007-12.

(56) References Cited

OTHER PUBLICATIONS

Dillon, Regulating gene expression in gene therapy. Trends Biotechnol. May 1993;11(5):167-73. doi: 10.1016/0167-7799(93)90109-M.

Ding et al., A Talen genome-editing system for generating human stem cell-based disease models. Cell Stem Cell. Feb. 7, 2013;12(2):238-51. Doi: 10.1016/j.stem.2012.11.011. Epub Dec. 13, 2012.

Ding et al., Permanent alteration of PCSK9 with in vivo CRISPR-Cas9 genome editing. Circ Res. Aug. 15, 20145;115(5):488-92. doi: 10.1161/CIRCRESAHA.115.304351. Epub Jun. 10, 2014.

Dingwall et al., Nuclear targeting sequences—a consensus? Trends Biochem Sci. Dec. 1991;16(12):478-81. doi: 10.1016/0968-0004(91)90184-w.

Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.

Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.

Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.

Dolan et al., Trans-splicing with the group I intron ribozyme from Azoarcus. RNA. Feb. 2014;20(2):202-13. doi: 10.1261/rna.041012.113. Epub Dec. 16, 2013.

Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.

Dominissini et al., Topology of the human and mouse m6A RNA methylomes revealed by m6A-seq. Nature. Apr. 29, 2012;485(7397):201-6. doi: 10.1038/nature11112.

Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.

Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.

Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.

Doudna et al., Genome editing. The new frontier of genome engineering with CRISPR-Cas9. Science. Nov. 28, 2014;346(6213):1258096. doi: 10.1126/science.1258096.

Doudna, The promise and challenge of therapeutic genome editing. Nature. Feb. 2020;578(7794):229-236. doi: 10.1038/s41586-020-1978-5. Epub Feb. 12, 2020.

Dove et al., Conversion of the omega subunit of *Escherichia coli* RNA polymerase into a transcriptional activator or an activation target. Genes Dev. Mar. 1, 1998;12(5):745-54.

Doyon et al., Directed evolution and substrate specificity profile of homing endonuclease I-SceI. J Am Chem Soc. Feb. 22, 2006;128(7):2477-84.

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.

Drake, A constant rate of spontaneous mutation in DNA-based microbes. Proc Natl Acad Sci USA. Aug. 15, 1991;88(16):7160-4.

Dubois et al., Retroviral RNA Dimerization: From Structure to Functions. Front Microbiol. Mar. 22, 2018;9:527. doi: 10.3389/fmicb.2018.00527.

Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.

Dunbar et al., Gene therapy comes of age. Science. Jan. 12, 2018;359(6372):eaan4672. doi: 10.1126/science.aan4672.

Dupuy et al., Le syndrome de De La Chapelle [De La Chapelle syndrome]. Presse Med. Mar. 3, 2001;30(8):369-72. French.

Durai et al., A bacterial one-hybrid selection system for interrogating zinc finger-DNA interactions. Comb Chem High Throughput Screen. May 2006;9(4):301-11.

Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.

During et al., Controlled release of dopamine from a polymeric brain implant: in vivo characterization. Ann Neurol. Apr. 1989;25(4):351-6.

Edlund et al., Cell-specific expression of the rat insulin gene: evidence for role of two distinct 5' flanking elements. Science. Nov. 22, 1985;230(4728):912-6. doi: 10.1126/science.3904002.

Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.

Edwards et al., Crystal structures of the thi-box riboswitch bound to thiamine pyrophosphate analogs reveal adaptive RNA-small molecule recognition. Structure. Sep. 2006;14(9):1459-68.

Eick et al., Robustness of Reconstructed Ancestral Protein Functions to Statistical Uncertainty. Mol Biol Evol. Feb. 1, 2017;34(2):247-261. doi: 10.1093/molbev/msw223.

Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Emery et al., HCN2 ion channels play a central role in inflammatory and neuropathic pain. Science. Sep. 9, 2011;333(6048):1462-6. doi: 10.1126/science.1206243.

Endo et al., Toward establishing an efficient and versatile gene targeting system in higher plants. Biocatalysis and Agricultural Biotechnology 2014;3,(1):2-6.

Engel et al., The emerging role of mRNA methylation in normal and pathological behavior. Genes Brain Behav. Mar. 2018;17(3):e12428. doi: 10.1111/gbb.12428. Epub Nov. 17, 2017.

Engelward et al., Base excision repair deficient mice lacking the Aag alkyladenine DNA glycosylase. Proc Natl Acad Sci U S A. Nov. 25, 1997;94(24):13087-92.

England, Unnatural amino acid mutagenesis: a precise tool for probing protein structure and function. Biochemistry. Sep. 21, 2004;43(37):11623-9.

Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.

Epstein, HSV-1-based amplicon vectors: design and applications. Gene Ther. Oct. 2005;12 Suppl 1:S154-8. doi: 10.1038/sj.gt.3302617.

Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.

Estacion et al., A sodium channel gene SCN9A polymorphism that increases nociceptor excitability. Ann Neurol. Dec. 2009;66(6):862-6. doi: 10.1002/ana.21895.

Esvelt et al., A system for the continuous directed evolution of biomolecules. Nature. Apr. 28, 2011;472(7344):499-503. doi: 10.1038/nature09929. Epub Apr. 10, 2011.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Evans et al., Protein trans-splicing and cyclization by a naturally split intein from the dnaE gene of Synechocystis species PCC6803. J Biol Chem. Mar. 31, 2000;275(13):9091-4. doi: 10.1074/jbc.275.13.9091.

(56) References Cited

OTHER PUBLICATIONS

Evans et al., Semisynthesis of cytotoxic proteins using a modified protein splicing element. Protein Sci. Nov. 1998;7(11):2256-64. doi: 10.1002/pro.5560071103.

Evans et al., The cyclization and polymerization of bacterially expressed proteins using modified self-splicing inteins. J Biol Chem. Jun. 25, 1999;274(26):18359-63. doi: 10.1074/jbc.274.26.18359.

Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.

Fagerlund et al., The Cpf1 CRISPR-Cas protein expands genome-editing tools. Genome Biology Nov. 17, 2015;16:251. https://doi.org/10.1186/s13059-015-0824-9.

Falnes et al., DNA repair by bacterial AlkB proteins. Res Microbiol. Oct. 2003;154(8):531-8. doi: 10.1016/S0923-2508(03)00150-5.

Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.

Fang et al., Synthetic Studies Towards Halichondrins: Synthesis of the Left Halves of Norhalichondrins and Homohalichondrins. Tetrahedron Letters 1992;33(12):1557-1560.

Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.

Farhood et al., Codelivery to mammalian cells of a transcriptional factor with cis-acting element using cationic liposomes. Anal Biochem. Feb. 10, 1995;225(1):89-93.

Fawcett et al., Transposable elements controlling I-R hybrid dysgenesis in D. melanogaster are similar to mammalian LINEs. Cell. Dec. 26, 1986;47(6):1007-15. doi: 10.1016/0092-8674(86)90815-9.

Feldstein et al., Two sequences participating in the autolytic processing of satellite tobacco ringspot virus complementary RNA. Gene. Oct. 15, 1989;82(1):53-61. doi: 10.1016/0378-1119(89)90029-2.

Felletti et al., Twister Ribozymes as Highly Versatile Expression Platforms for Artificial Riboswitches. Nat Commun. Sep. 27, 2016;7:12834. doi: 10.1038/ncomms12834.

Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.

Feng et al., Human L1 retrotransposon encodes a conserved endonuclease required for retrotransposition. Cell. Nov. 29, 1996;87(5):905-16. doi: 10.1016/s0092-8674(00)81997-2.

Ferretti et al., Complete genome sequence of an M1 strain of Streptococcus pyogenes. Proc Natl Acad Sci U S A. Apr. 10, 2001;98(8):4658-63.

Ferry et al., Rational design of inducible CRISPR guide RNAs for de novo assembly of transcriptional programs. Nat Commun. Mar. 3, 2017;8:14633. doi: 10.1038/ncomms14633.

Feuk, Inversion variants in the human genome: role in disease and genome architecture. Genome Med. Feb. 12, 2010;2(2):11. doi: 10.1186/gm132.

Filippov et al., A novel type of RNase III family proteins in eukaryotes. Gene. Mar. 7, 2000;245(1):213-21. doi: 10.1016/s0378-1119(99)00571-5.

Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.

Fire et al., Potent and specific genetic interference by double-stranded RNA in Caenorhabditis elegans. Nature. Feb. 19, 1998;391(6669):806-11. doi: 10.1038/35888.

Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.

Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.

Fitzjohn, Diversitree: comparative phylogenetic analyses of diversification in R. Methods in Evology and Evolution. Dec. 2012;3(6):1084-92 .doi: 10.1111/j.2041-210X.2012.00234.x.

Flajolet et al., Woodchuck hepatitis virus enhancer I and enhancer II are both involved in—myc2 activation in woodchuck liver tumors. J Virol. Jul. 1998;72(7):6175-80. doi: 10.1128/JVI.72.7.6175-6180.1998.

Flaman et al., A rapid PCR fidelity assay. Nucleic Acids Res. Aug. 11, 1994;22(15):3259-60. doi: 10.1093/nar/22.15.3259.

Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 1, 20159. Including supplementary figures and data.

Fogg et al., New applications for phage integrases. J Mol Biol. Jul. 29, 2014;426(15):2703-16. doi: 10.1016/j.jmb.2014.05.014. Epub May 22, 2014.

Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.

Forster et al., Self-cleavage of virusoid RNA is performed by the proposed 55-nucleotide active site. Cell. Jul. 3, 1987;50(1):9-16. doi: 10.1016/0092-8674(87)90657-x.

Fortini et al., Different DNA polymerases are involved in the short- and long-patch base excision repair in mammalian cells. Biochemistry. Mar. 17, 1998;37(11):3575-80. doi: 10.1021/bi972999h.

Fouts et al., Sequencing Bacillus anthracis typing phages gamma and cherry reveals a common ancestry. J Bacteriol. May 2006;188(9):3402-8. doi: 10.1128/JB.188.9.3402-3408.2006.

Freitas et al., Mechanisms and signals for the nuclear import of proteins. Curr Genomics. Dec. 2009;10(8):550-7. doi: 10.2174/138920209789503941.

Freshney, Culture of Animal Cells. A Manual of Basic Technique. Alan R. Liss, Inc. New York. 1983;4.

Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.

Fu et al., Promises and Pitfalls of Intracellular Delivery of Proteins. Bioconjugate Chemistry. Aug. 2014;25:1602-8.

Fuchs et al., Polyarginine as a multifunctional fusion tag. Protein Sci. Jun. 2005;14(6):1538-44.

Fujisawa et al., Disease-associated mutations in CIAS1 induce cathepsin B-dependent rapid cell death of human THP-1 monocytic cells. Blood. Apr. 1, 2007;109(7):2903-11.

Fukui et al., DNA Mismatch Repair in Eukaryotes and Bacteria. J Nucleic Acids. Jul. 27, 2010;2010. pii: 260512. doi: 10.4061/2010/260512.

Fung et al., Repair at single targeted DNA double-strand breaks in pluripotent and differentiated human cells. PLoS One. 2011;6(5):e20514. doi: 10.1371/journal.pone.0020514. Epub May 25, 2011.

Furukawa et al., In vitro selection of allosteric ribozymes that sense the bacterial second messenger c-di-GMP. Methods Mol Biol. 2014;1111:209-20. doi: 10.1007/978-1-62703-755-6_15.

Fusi et al., In Silico Predictive Modeling of CRISPR/Cas9 guide efficiency. Jun. 26, 2015; bioRxiv. http://dx.doi.org/10.1101/021568.

Gaj et al., 3rd. Genome engineering with custom recombinases. Methods Enzymol. 2014;546:79-91. doi: 10.1016/B978-0-12-801185-0.00004-0.

Gaj et al., A comprehensive approach to zinc-finger recombinase customization enables genomic targeting in human cells. Nucleic Acids Res. Feb. 6, 2013;41(6):3937-46.

(56) References Cited

OTHER PUBLICATIONS

Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.

Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.

Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.

Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.

Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.

Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.

Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.

Gao et al., Cationic liposome-mediated gene transfer. Gene Ther. Dec. 1995;2(10):710-22.

Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.

Gapinske et al., CRISPR-SKIP: programmable gene splicing with single base editors. Genome Biol. Aug. 15, 2018;19(1):107. doi: 10.1186/s13059-018-1482-5.

Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.

Gardlik et al., Vectors and delivery systems in gene therapy. Med Sci Monit. Apr. 2005;11(4):RA110-21. Epub Mar. 24, 2005.

Garibyan et al., Use of the rpoB gene to determine the specificity of base substitution mutations on the *Escherichia coli* chromosome. DNA Repair (Amst). May 13, 2003;2(5):593-608.

Garneau et al., The CRISPR/Cas bacterial immune system cleaves bacteriophage and plasmid DNA. Nature. Nov. 4, 2010;468(7320):67-71. doi: 10.1038/nature09523.

Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.

Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.

Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.

Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.

GenBank Accession No. J01600.1. Brooks et al., *E. coli* dam gene coding for DNA adenine methylase. Apr. 26, 1993.

GenBank Accession No. U07651.1. Lu, *Escherichia coli* K12 negative regulator of replication initiation (seqA) gene, complete cds. Jul. 19, 1994.

GenBank Submission; NIH/NCBI Accession No. 4UN5_B. Anders et al., Jul. 23, 2014. 5 pages.

GenBank Submission; NIH/NCBI, Accession No. AAA66622.1. Martinelli et al., May 18, 1995. 2 pages.

GenBank Submission; NIH/NCBI, Accession No. AGT42196. Farzadfar et al., Nov. 2, 2013. 2 pages.

GenBank Submission; NIH/NCBI, Accession No. AIT42264.1. Hyun et al., Oct. 15, 2014. 2 pages.

GenBank Submission; NIH/NCBI, Accession No. AKA60242.1. Tong et al., Apr. 5, 2015. 1 page.

GenBank Submission; NIH/NCBI, Accession No. AKQ21048.1. Gilles et al., Jul. 19, 2015. 1 page.

GenBank Submission; NIH/NCBI, Accession No. AKS40380.1. Nodvig et al., Aug. 2, 2015. 1 page.

GenBank Submission; NIH/NCBI, Accession No. APG80656.1. Burstein et al., Dec. 10, 2016. 1 pages.

GenBank Submission; NIH/NCBI, Accession No. AYD60528.1. Ram et al., Oct. 2, 2018. 1 page.

GenBank Submission; NIH/NCBI, Accession No. BDB43378. Zhang et al., Aug. 11, 2016. 2 pages.

GenBank Submission; NIH/NCBI, Accession No. J04623. Kita et al., Apr. 26, 1993. 2 pages.

GenBank Submission; NIH/NCBI, Accession No. KR710351.1. Sahni et al., Jun. 1, 2015. 2 pages.

GenBank Submission; NIH/NCBI, Accession No. NC_002737.1. Ferretti et al., Jun. 27, 2013. 1 page.

GenBank Submission; NIH/NCBI, Accession No. NC_015683.1. Trost et al., Jul. 6, 2013. 1 page.

GenBank Submission; NIH/NCBI, Accession No. NC_016782.1. Trost et al., Jun. 11, 2013. 1 page.

GenBank Submission; NIH/NCBI, Accession No. NC_016786.1. Trost et al., Aug. 28, 2013. 1 page.

GenBank Submission; NIH/NCBI, Accession No. NC_017053.1. Fittipaldi et al., Jul. 6, 2013. 1 page.

GenBank Submission; NIH/NCBI, Accession No. NC_017317.1. Trost et al., Jun. 11, 2013. 1 page.

GenBank Submission; NIH/NCBI, Accession No. NC_017861.1. Heidelberg et al., Jun. 11, 2013. 1 page.

GenBank Submission; NIH/NCBI, Accession No. NC_018010.1. Lucas et al., Jun. 11, 2013. 2 pages.

GenBank Submission; NIH/NCBI, Accession No. NC_018721.1. Feng et al., Jun. 11, 2013. 1 pages.

GenBank Submission; NIH/NCBI, Accession No. NC_021284.1. Ku et al., Jul. 12, 2013. 1 page.

GenBank Submission; NIH/NCBI, Accession No. NC_021314.1. Zhang et al., Jul. 15, 2013. 1 page.

GenBank Submission; NIH/NCBI, Accession No. NC_021846.1. Lo et al., Jul. 22, 2013. 1 page.

GenBank Submission; NIH/NCBI, Accession No. NM_002945.3. Weiser et al., Sep. 3, 2017. 5 pages.

GenBank Submission; NIH/NCBI, Accession No. NM_002947.4. Xiao et al., May 1, 2019. 4 pages.

GenBank Submission; NIH/NCBI, Accession No. NM_174936. Guo et al., Oct. 28, 2015. 6 pages.

GenBank Submission; NIH/NCBI, Accession No. NP_358988.1. Hoskins et al., Jan. 11, 2017. 2 pages.

GenBank Submission; NIH/NCBI, Accession No. NP_472073.1. Glaser et al., Jun. 27, 2013. 2 pages.

GenBank Submission; NIH/NCBI, Accession No. NP_628093.1. Hsiao et al., Aug. 3, 2016. 2 pages.

GenBank Submission; NIH/NCBI, Accession No. NP_955579.1. Chen et al., Aug. 13, 2018. 5 pages.

GenBank Submission; NIH/NCBI, Accession No. P42212. Prasher et al., Mar. 19, 2014. 7 pages.

GenBank Submission; NIH/NCBI, Accession No. QBJ66766. Duan et al. Aug. 12, 2020. 2 pages.

GenBank Submission; NIH/NCBI, Accession No. RFF81513.1. Zhou et al., Aug. 21, 2018. 2 pages.

GenBank Submission; NIH/NCBI, Accession No. SNX31424.1. Weckx, S., Feb. 16, 2018. 2 pages.

GenBank Submission; NIH/NCBI, Accession No. TGH57013. Xu et al., Apr. 9, 2019. 2 pages.

GenBank Submission; NIH/NCBI, Accession No. WP_002989955.1. No Author Listed, May 6, 2013. 1 page.

GenBank Submission; NIH/NCBI, Accession No. WP_010922251.1. No Author Listed, May 15, 2013. 1 page.

(56) References Cited

OTHER PUBLICATIONS

GenBank Submission; NIH/NCBI, Accession No. WP_011054416. 1. No Author Listed, May 15, 2013. 1 page.
GenBank Submission; NIH/NCBI, Accession No. WP_011284745. 1. No Author Listed, May 16, 2013. 1 page.
GenBank Submission; NIH/NCBI, Accession No. WP_011285506. 1. No Author Listed, May 16, 2013. 1 page.
GenBank Submission; NIH/NCBI, Accession No. WP_011527619. 1. No Author Listed, May 16, 2013. 1 page.
GenBank Submission; NIH/NCBI, Accession No. WP_012560673. 1. No Author Listed, May 17, 2013. 1 page.
GenBank Submission; NIH/NCBI, Accession No. WP_014407541. 1. No Author Listed, May 18, 2013. 1 page.
GenBank Submission; NIH/NCBI, Accession No. WP_016631044. 1. Haft et al., Sep. 22, 2020. 1 page.
GenBank Submission; NIH/NCBI, Accession No. WP_020905136. 1. No Author Listed, Jul. 25, 2013. 1 page.
GenBank Submission; NIH/NCBI, Accession No. WP_023080005. 1. No Author Listed, Oct. 27, 2013. 1 page.
GenBank Submission; NIH/NCBI, Accession No. WP_023610282. 1. No Author Listed, Nov. 27, 2013. 1 page.
GenBank Submission; NIH/NCBI, Accession No. WP_030125963. 1. No Author Listed, Jul. 9, 2014. 1 page.
GenBank Submission; NIH/NCBI, Accession No. WP_030126706. 1. No Author Listed, Jul. 9, 2014. 1 page.
GenBank Submission; NIH/NCBI, Accession No. WP_031386437. No Author Listed., Sep. 23, 2019. 1 page.
GenBank Submission; NIH/NCBI, Accession No. WP_031488318. 1. No Author Listed., Aug. 5, 2014. 1 page.
GenBank Submission; NIH/NCBI, Accession No. WP_031589969. 1. Haft et al., Oct. 9, 2019. 2 pages.
GenBank Submission; NIH/NCBI, Accession No. WP_032460140. 1. No Author Listed, Oct. 4, 2014. 1 page.
GenBank Submission; NIH/NCBI, Accession No. WP_032461047. 1. No Author Listed, Oct. 4, 2014. 1 page.
GenBank Submission; NIH/NCBI, Accession No. WP_032462016. 1. Haft et al., Oct. 4, 2014. 1 page.
GenBank Submission; NIH/NCBI, Accession No. WP_032462936. 1. No Author Listed, Oct. 4, 2014. 1 page.
GenBank Submission; NIH/NCBI, Accession No. WP_032464890. 1. No Author Listed, Oct. 4, 2014. 1 page.
GenBank Submission; NIH/NCBI, Accession No. WP_038431314. 1. No Author Listed, Dec. 26, 2014. 1 page.
GenBank Submission; NIH/NCBI, Accession No. WP_038432938. 1. No Author Listed, Dec. 26, 2014. 1 page.
GenBank Submission; NIH/NCBI, Accession No. WP_038434062. 1. No Author Listed, Dec. 26, 2014. 1 page.
GenBank Submission; NIH/NCBI, Accession No. WP_044924278. 1. Haft et al., Oct. 9, 2019. 2 pages.
GenBank Submission; NIH/NCBI, Accession No. WP_047338501. 1. Haft et al., Oct. 9, 2019. 2 pages.
GenBank Submission; NIH/NCBI, Accession No. WP_048327215. 1. No Author Listed, Jun. 26, 2015. 1 page.
GenBank Submission; NIH/NCBI, Accession No. WP_049519324. 1. No Author Listed, Jul. 20, 2015. 1 page.
GenBank Submission; NIH/NCBI, Accession No. WP_060798984. 1. Haft et al., Oct. 9, 2019. 2 pages.
GenBank Submission; NIH/NCBI, Accession No. WP_062913273. 1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515. 1. No Author Listed., Sep. 23, 2019. 1 page.
GenBank Submission; NIH/NCBI, Accession No. WP_118538418. 1. No Author Listed., Oct. 13, 2019. 1 page.
GenBank Submission; NIH/NCBI, Accession No. WP_119223642. 1. No Author Listed., Oct. 13, 2019. 1 page.
GenBank Submission; NIH/NCBI, Accession No. WP_119227726. 1. No Author Listed., Oct. 13, 2019. 1 page.
GenBank Submission; NIH/NCBI, Accession No. WP_119623382. 1. No Author Listed., Oct. 13, 2019. 1 page.
GenBank Submission; NIH/NCBI, Accession No. WP_132221894. 1. No Author Listed., Sep. 23, 2019. 1 page.
GenBank Submission; NIH/NCBI, Accession No. WP_133478044. 1. Haft et al., Oct. 9, 2019. 2 pages.
GenBank Submission; NIH/NCBI, Accession No. YP_002342100. 1. Bernardini et al., Jun. 10, 2013. 2 pages.
GenBank Submission; NIH/NCBI, Accession No. YP_002344900. 1. Gundogdu et al., Mar. 19, 2014. 2 pages.
GenBank Submission; NIH/NCBI, Accession No. YP_009137104. 1. Davison, Aug. 13, 2018. 2 pages.
GenBank Submission; NIH/NCBI, Accession No. YP_009283008. 1. Bernardini et al., Sep. 23, 2016. 2 pages.
GenBank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al., DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.

(56) References Cited

OTHER PUBLICATIONS

Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.

Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):p. 23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004; 166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue): W70-4. doi: 10.1093/nar/gkn188. Epub Apr. 19, 2008.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guedon et al., Current gene therapy using viral vectors for chronic pain. Mol Pain. May 13, 2015;11:27. doi: 10.1186/s12990-015-0018-1.
Guilinger et al., Broad specificity profiling of TALENs results in engineered nucleases with improved DNA-cleavage specificity. Nat Methods. Apr. 2014; 11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Evolution of Tetrahymena ribozyme mutants with increased structural stability. Nat Struct Biol. Nov. 2002;9(11):855-61. doi: 10.1038/nsb850.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.
Guo et al., Structure of Cre recombinase complexed with DNA in a site-specific recombination synapse. Nature. Sep. 4, 1997;389(6646):40-6.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.
Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.
Harms et al., Evolutionary biochemistry: revealing the historical and physical causes of protein properties. Nat Rev Genet. Aug. 2013;14(8):559-71. doi: 10.1038/nrg3540.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.

(56) References Cited

OTHER PUBLICATIONS

Harris et al., RNA Editing Enzyme APOBEC1 and Some of Its Homologs Can Act as DNA Mutators. Mol Cell. Nov. 2002;10(5):1247-53.

Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

Hartung et al., Cre mutants with altered DNA binding properties. J Biol Chem. Sep. 4, 1998;273(36):22884-91.

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.

Hasegawa et al., Spontaneous mutagenesis associated with nucleotide excision repair in *Escherichia coli*. Genes Cells. May 2008;13(5):459-69. doi: 10.1111/j.1365-2443.2008.01185.x.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Hector et al., CDKL5 variants: Improving our understanding of a rare neurologic disorder. Neurol Genet. Dec. 15, 2017;3(6):e200. doi: 10.1212/NXG.0000000000000200.

Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.

Heller et al., Replisome assembly and the direct restart of stalled replication forks. Nat Rev Mol Cell Biol. Dec. 2006;7(12):932-43. Epub Nov. 8, 2006.

Hendricks et al., The S. cerevisiae Mag1 3-methyladenine DNA glycosylase modulates susceptibility to homologous recombination. DNA Repair (Amst). 2002;1(8):645-659.

Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.

Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.

Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.

Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

Hill et al., Functional analysis of conserved histidines in ADP-glucose pyrophosphorylase from *Escherichia coli*.Biochem Biophys Res Commun. Mar. 17, 1998;244(2):573-7.

Hille et al., The Biology of CRISPR-Cas: Backward and Forward. Cell. Mar. 8, 2018;172(6):1239-1259. doi: 10.1016/j.cell.2017.11.032.

Hilton et al., Enabling functional genomics with genome engineering. Genome Res. Oct. 2015;25(10):1442-55. doi: 10.1101/gr.190124.115.

Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.

Hirano et al., Structural Basis for the Altered PAM Specificities of Engineered CRISPR-Cas9. Mol Cell. Mar. 17, 2016;61(6):886-94. doi: 10.1016/j.molcel.2016.02.018.

Hoang et al., UFBoot2: Improving the Ultrafast Bootstrap Approximation. Mol Biol Evol. Feb. 1, 2018;35(2):518-522. doi: 10.1093/molbev/msx281.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hoernes et al., Translating the epitranscriptome. Wiley Interdiscip Rev RNA. Jan. 2017;8(1):e1375. doi: 10.1002/wrna.1375. Epub Jun. 27, 2016.

Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hollis et al., Phage integrases for the construction and manipulation of transgenic mammals. Reprod Biol Endocrinol. Nov. 7, 2003;1:79. doi: 10.1186/1477-7827-1-79.

Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.

Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.

Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011;286(50):43112-22. doi: 10.1074/jbc.M111.252775.

Hoogenboom et al., Natural and designer binding sites made by phage display technology. Immunol Today. Aug. 2000;21(8):371-8.

Horvath et al., CRISPR/Cas, the immune system of bacteria and archaea. Science. Jan. 8, 2010;327(5962):167-70. doi: 10.1126/science.1179555.

Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.

Hotta et al., [Neurotropic viruses—classification, structure and characteristics]. Nihon Rinsho. Apr. 1997;55(4):777-82. Japanese.

Houdebine, The methods to generate transgenic animals and to control transgene expression. J Biotechnol. Sep. 25, 2002;98(2-3):145-60.

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Howard et al., Intracerebral drug delivery in rats with lesion-induced memory deficits. J Neurosurg. Jul. 1989;71(1):105-12.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.

Hua et al., Expanding the base editing scope in rice by using Cas9 variants. Plant Biotechnol J. Feb. 2019;17(2):499-504. doi: 10.1111/pbi.12993. Epub Oct. 5, 2018.

Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 20190. Including Supplementary Information.

(56) References Cited

OTHER PUBLICATIONS

Huang et al., Heritable gene targeting in zebrafish using customized TALENs. Nat Biotechnol. Aug. 5, 2011;29(8):699-700. doi: 10.1038/nbt.1939.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Humbert et al., Targeted gene therapies: tools, applications, optimization. Crit Rev Biochem Mol Biol. May-Jun. 2012;47(3):264-81. doi: 10.3109/10409238.2012.658112.

Hung et al., Protein localization in disease and therapy. J Cell Sci. Oct. 15, 2011;124(Pt 20):3381-92. doi: 10.1242/jcs.089110.

Hurt et al., Highly specific zinc finger proteins obtained by directed domain shuffling and cell- based selection. Proc Natl Acad Sci U S A. Oct. 14, 2003;100(21):12271-6. Epub Oct. 3, 2003.

Husimi, Selection and evolution of bacteriophages in cellstat. Adv Biophys. ; 1989;25:1-43. Review.

Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Ikediobi et al., Mutation analysis of 24 known cancer genes in the NCI-60 cell line set. Mol Cancer Ther. Nov. 2006;5(11):2606-12. Epub Nov. 6, 2006.

Imanishi et al., Detection of N6-methyladenosine based on the methyl-sensitivity of MazF RNA endonuclease. Chem Commun (Camb). Nov. 30, 201;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Jaffrey et al., Emerging links between m6A and misregulated mRNA methylation in cancer. Genome Med. Jan. 12, 2017;9(1):2. doi: 10.1186/s13073-016-0395-8.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jansen et al., Identification of genes that are associated with DNA repeats in prokaryotes. Mol Microbiol. Mar. 2002;43(6):1565-75.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jemielity et al., Novel "anti-reverse" cap analogs with superior translational properties. RNA. Sep. 2003;9(9):1108-22. doi: 10.1261/rna.5430403.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jiang et al., Chemical modifications of adenine base editor mRNA and guide RNA expand its application scope. Nat Commun. Apr. 24, 2020;11(1):1979. doi: 10.1038/s41467-020-15892-8.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.

Jiang et al., Structural Biology. A Cas9-guide RNA Complex Preorganized for Target DNA Recognition. Science. Jun. 26, 2015;348(6242):1477-81. doi: 10.1126/science.aab1452.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jiricny, The multifaceted mismatch-repair system. Nat Rev Mol Cell Biol. May 2006;7(5):335-46. doi: 10.1038/nrm1907.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

Johns et al., The promise and peril of continuous in vitro evolution. J Mol Evol. Aug. 2005;61(2):253-63. Epub Jun. 27, 2005.

Johnson et al., Trans insertion-splicing: ribozyme-catalyzed insertion of targeted sequences into RNAs. Biochemistry. Aug. 9, 2005;44(31):10702-10. doi: 10.1021/bi0504815.

(56) References Cited

OTHER PUBLICATIONS

Joho et al., Identification of a region of the bacteriophage T3 and T7 Rna polymerases that determines promoter specificity. J Mol Biol. Sep. 5, 1990;215(1):31-9.

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.

Joung et al., TALENs: a widely applicable technology for targeted genome editing. Nat Rev Mol Cell Biol. Jan. 2013;14(1):49-55. doi: 10.1038/nrm3486. Epub Nov. 21, 2012.

Joyce et al., Amplification, mutation and selection of catalytic RNA. Gene. Oct. 15, 1989;82(1):83-7. doi: 10.1016/0378-1119(89)90033-4.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.

Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.

Kahmann et al., G inversion in bacteriophage Mu DNA is stimulated by a site within the invertase gene and a host factor. Cell. Jul. 1985;41(3):771-80. doi: 10.1016/s0092-8674(85)80058-1.

Kaiser et al., Gene therapy. Putting the fingers on gene repair. Science. Dec. 23, 2005;310(5756):1894-6.

Kakiyama et al., A peptide release system using a photo-cleavable linker in a cell array format for cell-toxicity analysis. Polymer J. Feb. 27, 2013;45:535-9.

Kalyaanamoorthy et al., ModelFinder: fast model selection for accurate phylogenetic estimates. Nat Methods. Jun. 2017; 14(6):587-589. doi: 10.1038/nmeth.4285. Epub May 8, 2017.

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.

Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.

Kao et al., Cleavage specificity of Saccharomyces cerevisiae flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Kappel et al., Regulating gene expression in transgenic animals. Curr Opin Biotechnol. Oct. 1992;3(5):548-53.

Karimova et al., Discovery of Nigri/nox and Panto/pox site-specific recombinase systems facilitates advanced genome engineering. Sci Rep. Jul. 22, 2016;6:30130. doi: 10.1038/srep30130.

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.

Kaufman et al., Translational efficiency of polycistronic mRNAs and their utilization to express heterologous genes in mammalian cells. EMBO J. Jan. 1987;6(1):187-93.

Kavli et al., Excision of cytosine and thymine from DNA by mutants of human uracil-DNA glycosylase. EMBO J. Jul. 1, 1996;15(13):3442-7.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Kay et al., Viral vectors for gene therapy: the art of turning infectious agents into vehicles of therapeutics. Nat Med. Jan. 2001;7(1):33-40.

Kaya et al., A bacterial Argonaute with noncanonical guide RNA specificity. Proc. Natl. Acad. Sci. USA Apr. 2016;113(15):4057-62.

Keijzers et al., Human exonuclease 1 (EXO1) activity characterization and its function on flap structures. Biosci Rep. Apr. 25, 2015;35(3):e00206. doi: 10.1042/BSR20150058.

Kellendonk et al., Regulation of Cre recombinase activity by the synthetic steroid RU 486. Nucleic Acids Res. Apr. 15, 1996;24(8):1404-11.

Kelman, PCNA: structure, functions and interactions. Oncogene. Feb. 13, 1997;14(6):629-40. doi: 10.1038/sj.onc.1200886.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.

Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.

Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.

Kilbride et al., Determinants of product topology in a hybrid Cre-Tn3 resolvase site-specific recombination system. J Mol Biol. Jan. 13, 2006;355(2):185-95. Epub Nov. 9, 2005.

Kilcher et al., Brochothrix thermosphacta bacteriophages feature heterogeneous and highly mosaic genomes and utilize unique prophage insertion sites. J Bacteriol. Oct. 2010; 192(20):5441-53. doi: 10.1128/JB.00709-10. Epub Aug. 13, 2010.

Kim et al., DJ-1, a novel regulator of the tumor suppressor PTEN. Cancer Cell. 2005;7(3):263-273.

Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.

Kim et al., A library of TAL effector nucleases spanning the human genome. Nat Biotechnol. Mar. 2013;31(3):251-8. Doi: 10.1038/nbt.2517. Epub Feb. 17, 2013.

(56) References Cited

OTHER PUBLICATIONS

Kim et al., An anionic human protein mediates cationic liposome delivery of genome editing proteins into mammalian cells. Nat Commun. Jul. 2, 2019;10(1):2905. doi: 10.1038/s41467-019-10828-3.

Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.

Kim et al., Genome-wide target specificities of CRISPR RNA-guided programmable deaminases. Nat Biotechnol. May 2017;35(5):475-480. doi: 10.1038/nbt.3852. Epub Apr. 10, 2017.

Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.

Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.

Kim et al., Highly efficient RNA-guided base editing in mouse embryos. Nat Biotechnol. May 2017;35(5):435-437. doi: 10.1038/nbt.3816. Epub Feb. 27, 2017.

Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.

Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.

Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.

Kim et al., Mycobacteriophage Bxb1 integrates into the Mycobacterium smegmatis groEL1 gene. Mol Microbiol. Oct. 2003;50(2):463-73. doi: 10.1046/j.1365-2958.2003.03723.x.

Kim et al., Rescue of high-specificity Cas9 variants using sgRNAs with matched 5' nucleotides. Genome Biol. Nov. 15, 2017;18(1):218. doi: 10.1186/s13059-017-1355-3.

Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.

Kim et al., TALENs and ZFNs are associated with different mutationsignatures. Nat Methods. Mar. 2013;10(3):185. doi: 10.1038/nmeth.2364. Epub Feb. 10, 2013.

Kim et al., Targeted genome editing in human cells with zinc finger nucleases constructed via modular assembly. Genome Res. Jul. 2009;19(7):1279-88. doi: 10.1101/gr.089417.108. Epub May 21, 2009.

Kim et al., The role of apolipoprotein E in Alzheimer's disease. Neuron. Aug. 13, 2009;63(3):287-303. doi: 10.1016/j.neuron.2009.06.026.

Kim et al., Transcriptional repression by zinc finger peptides. Exploring the potential for applications in gene therapy. J Biol Chem. Nov. 21, 1997;272(47):29795-800.

Kitamura et al., Uracil DNA glycosylase counteracts APOBEC3G-induced hypermutation of hepatitis B viral genomes: excision repair of covalently closed circular Dna. PLoS Pathog. 2013;9(5):e1003361. doi: 10.1371/journal.ppat.1003361. Epub May 16, 2013.

Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.

Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.

Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.

Klippel et al., Isolation and characterization of unusual gin mutants. EMBO J. Dec. 1, 1988;7(12):3983-9.

Klippel et al., The DNA invertase Gin of phage Mu: formation of a covalent complex with DNA via a phosphoserine at amino acid position 9. EMBO J. Apr. 1988;7(4):1229-37.

Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.

Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.

Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.

Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.

Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.

Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.

Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.

Kolot et al., Site-specific recombination in mammalian cells expressing the Int recombinase of bacteriophage HK022. Mol Biol Rep. Aug. 1999;26(3):207-13. doi: 10.1023/a:1007096701720.

Komor et al., CRISPR-Based Technologies for the Manipulation of Eukaryotic Genomes. Cell. Jan. 12, 2017;168(1-2):20-36. doi: 10.1016/j.cell.2016.10.044.

Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.

Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.

Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.

Koonin et al., Diversity, classification and evolution of CRISPR-Cas systems. Curr Opin Microbiol. 2017;37:67?78. doi:10.1016/j.mib.2017.05.008.

Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.

Kotewicz et al., Cloning and overexpression of Moloney murine leukemia virus reverse transcriptase in *Escherichia coli*. Gene. 1985;35(3):249-58. doi: 10.1016/0378-1119(85)90003-4.

Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.

Kotin, Prospects for the use of adeno-associated virus as a vector for human gene therapy. Hum Gene Ther. Jul. 1994;5(7):793-801. doi: 10.1089/hum.1994.5.7-793.

Kouzminova et al., Patterns of chromosomal fragmentation due to uracil-DNA incorporation reveal a novel mechanism of replication-

(56) References Cited

OTHER PUBLICATIONS dependent double-stranded breaks. Mol Microbiol. Apr. 2008;68(1):202-15. doi: 10.1111/j.1365-2958.2008.06149.x.

Kowal et al., Exploiting unassigned codons in Micrococcus luteus for tRNA-based amino acid mutagenesis. Nucleic Acids Res. Nov. 15, 1997;25(22):4685-9.

Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.

Kozak, An analysis of 5'-noncoding sequences from 699 vertebrate messenger RNAs. Nucleic Acids Res. Oct. 26, 1987;15(20):8125-48. doi: 10.1093/nar/15.20.8125.

Kremer et al., Adenovirus and adeno-associated virus mediated gene transfer. Br Med Bull. Jan. 1995;51(1):31-44. doi: 10.1093/oxfordjournals.bmb.a072951.

Krokan et al., Uracil in DNA—occurrence, consequences and repair. Oncogene. Dec. 16, 2002;21(58):8935-48. doi: 10.1038/sj.onc.1205996.

Krokan et al., Base excision repair. Cold Spring Harb Perspect Biol. Apr. 1, 2013;5(4):a012583. doi: 10.1101/cshperspect.a012583.

Krzywkowski et al., Limited reverse transcriptase activity of phi29 DNA polymerase. Nucleic Acids Res. Apr. 20, 2018;46(7):3625-3632. doi: 10.1093/nar/gky190.

Kumar et al., Gene therapy for chronic neuropathic pain: how does it work and where do we stand today? Pain Med. May 2011;12(5):808-22. doi: 10.1111/j.1526-4637.2011.01120.x.

Kumar et al., Structural and functional consequences of the mutation of a conserved arginine residue in alphaA and alphaB crystallins. J Biol Chem. Aug. 20, 1999;274(34):24137-41.

Kundu et al., Leucine to proline substitution by SNP at position 197 in Caspase-9 gene expression leads to neuroblastoma: a bioinformatics analysis. 3 Biotech. 2013; 3:225-34.

Kunkel et al., Eukaryotic Mismatch Repair in Relation to DNA Replication. Annu Rev Genet. 2015;49:291-313. doi: 10.1146/annurev-genet-112414-054722.

Kunz et al., DNA Repair in mammalian cells: Mismatched repair: variations on a theme. Cell Mol Life Sci. Mar. 2009;66(6):1021-38. doi: 10.1007/s00018-009-8739-9.

Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.

Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.

Kuscu et al., CRISPR-Cas9-AID base editor is a powerful gain-of-function screening tool. Nat Methods. Nov. 29, 2016;13(12):983-984. doi: 10.1038/nmeth.4076.

Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Kwart et al., Precise and efficient scarless genome editing in stem cells using CORRECT. Nat Protoc. Feb. 2017;12(2):329-354. doi: 10.1038/nprot.2016.171. Epub Jan. 19, 2017.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Kwon et al., Chemical basis of glycine riboswitch cooperativity. RNA. Jan. 2008;14(1):25-34. Epub Nov. 27, 2007.

Köhrer et al., A possible approach to site-specific insertion of two different unnatural amino acids into proteins in mammalian cells via nonsense suppression. Chem Biol. Nov. 2003; 10(11):1095-102.

Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.

Kügler et al., Human synapsin 1 gene promoter confers highly neuron-specific long-term transgene expression from an adenoviral vector in the adult rat brain depending on the transduced area. Gene Ther. Feb. 2003; 10(4):337-47. doi: 10.1038/sj.gt.3301905.

Lada et al., Mutator effects and mutation signatures of editing deaminases produced in bacteria and yeast. Biochemistry (Mosc). Jan. 2011;76(1):131-46.

Lakich et al., Inversions disrupting the factor VIII gene are a common cause of severe haemophilia A. Nat Genet. Nov. 1993;5(3):236-41. doi: 10.1038/ng1193-236.

Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.

Langer et al., New methods of drug delivery. Science. Sep. 28, 1990;249(4976):1527-33.

Lapinaite et al., DNA capture by a CRISPR-Cas9-guided adenine base editor. Science. Jul. 31, 2020;369(6503):566-571. doi: 10.1126/science.abb1390.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lau et al., Molecular basis for discriminating between normal and damaged bases by the human alkyladenine glycosylase, AAG. Proc Natl Acad Sci U S A. Dec. 5, 2000;97(25):13573-8.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.

Lazar et al., Transforming growth factor alpha: mutation of aspartic acid 47 and leucine 48 results in different biological activities. Mol Cell Biol. Mar. 1988;8(3):1247-52.

Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.

Le Grice et al., Purification and characterization of recombinant equine infectious anemia virus reverse transcriptase. J Virol. Dec. 1991;65(12):7004-7. doi: 10.1128/JVI.65.12.7004-7007.1991.

Leaver-Fay et al., ROSETTA3: an object-oriented software suite for the simulation and design of macromolecules. Methods Enzymol. 2011;487:545-74. doi: 10.1016/B978-0-12-381270-4.00019-6.

Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., A monoclonal antibody that targets a NaV1.7 channel voltage sensor for pain and itch relief. Cell. Jun. 5, 2014;157(6):1393-

(56) References Cited

OTHER PUBLICATIONS 1404. doi: 10.1016/j.cell.2014.03.064. Epub May 22, 2014. Retraction in: Cell. Jun. 25, 2020;181(7):1695.
Lee et al., An allosteric self-splicing ribozyme triggered by a bacterial second messenger. Science. Aug. 13, 2010;329(5993):845-8. doi: 10.1126/science.1190713.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.
Lee et al., PIK3CA gene is frequently mutated in breast carcinomas and hepatocellular carcinomas. Oncogene. Feb. 17, 2005;24(8):1477-80.
Lee et al., Recognition of liposomes by cells: in vitro binding and endocytosis mediated by specific lipid headgroups and surface charge density. Biochim Biophys Acta. Jan. 31, 1992;1103(2):185-97.
Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.
Lee et al., Simultaneous targeting of linked loci in mouse embryos using base editing. Sci Rep. Feb. 7, 2019;9(1):1662. doi: 10.1038/s41598-018-33533-5.
Lee et al., Site-specific integration of mycobacteriophage L5: integration-proficient vectors for Mycobacterium smegmatis, *Mycobacterium tuberculosis*, and bacille Calmette-Guérin. Proc Natl Acad Sci U S A. Apr. 15, 1991;88(8):3111-5. doi: 10.1073/pnas.88.8.3111.
Lee et al., Synthetically modified guide RNA and donor DNA are a versatile platform for CRISPR-Cas9 engineering. Elife. May 2, 2017;6:e25312. doi: 10.7554/eLife.25312.
Lee et al., Targeted chromosomal deletions in human cells using zinc finger nucleases. Genome Res. Jan. 2010 20: 81-89; Published in Advance Dec. 1, 2009, doi:10.1101/gr.099747.109.
Lee et al., Targeting fidelity of adenine and cytosine base editors in mouse embryos. Nat Commun. Nov. 15, 2018;9(1):4804. doi: 10.1038/s41467-018-07322-7.
Lee et al., Transcriptional regulation and its misregulation in disease. Cell. Mar. 14, 2013;152(6):1237-51. doi: 10.1016/j.cell.2013.02.014.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.
Leipold et al., A de novo gain-of-function mutation in SCN11A causes loss of pain perception. Nat Genet. Nov. 2013;45(11):1399-404. doi: 10.1038/ng.2767. Epub Sep. 15, 2013.
Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.
Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.
Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.
Levy et al., Inhibition of calcification of bioprosthetic heart valves by local controlled-release diphosphonate. Science. Apr. 12, 1985;228(4696):190-2.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.
Lew et al., Protein splicing in vitro with a semisynthetic two-component minimal intein. J Biol Chem. Jun. 26, 1998;273(26):15887-90. doi: 10.1074/jbc.273.26.15887.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Lewis et al., Building the Class 2 CRISPR-Cas Arsenal. Mol Cell 2017;65(3);377-379.
Lewis et al., Codon 129 polymorphism of the human prion protein influences the kinetics of amyloid formation. J Gen Virol. Aug. 2006;87(Pt 8):2443-9.
Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.
Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.
Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.
Li et al., Base editing with a Cpf1-cytidine deaminase fusion. Nat Biotechnol. Apr. 2018;36(4):324-327. doi: 10.1038/nbt.4102. Epub Mar. 19, 2018.
Li et al., Current approaches for engineering proteins with diverse biological properties. Adv Exp Med Biol. 2007;620:18-33.
Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.
Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.
Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.
Li et al., Highly efficient and precise base editing in discarded human tripronuclear embryos. Protein Cell. Aug. 19, 2017. doi: 10.1007/s13238-017-0458-7. [Epub ahead of print].
Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.
Li et al., Loss of post-translational modification sites in disease. Pac Symp Biocomput. 2010:337-47. doi: 10.1142/9789814295291_0036.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.
Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

(56) References Cited

OTHER PUBLICATIONS

Li, Mechanisms and functions of DNA mismatch repair. Cell Res. Jan. 2008;18(1):85-98. doi: 10.1038/cr.2007.115.
Liang et al., Correction of ?-thalassemia mutant by base editor in human embryos. Protein Cell. Nov. 2017;8(11):811-822. doi: 10.1007/s13238-017-0475-6. Epub Sep. 23, 2017.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Lieber et al., Mechanism and regulation of human non-homologous DNA end-joining. Nat Rev Mol Cell Biol. Sep. 2003;4(9):712-20.
Liefke et al., The oxidative demethylase ALKBH3 marks hyperactive gene promoters in human cancer cells. Genome Med. Jun. 30, 2015;7(1):66. doi: 10.1186/s13073-015-0180-0.
Lienert et al., Two- and three-input TALE-based and logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.
Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Liu et al., Fast Colorimetric Sensing of Adenosine and Cocaine Based on a General Sensor Design Involving Aptamers and Nanoparticles. Angew Chem. 2006;118(1):96-100.
Liu et al., Flap endonuclease 1: a central component of DNA metabolism. Annu Rev Biochem. 2004;73:589-615. doi:10.1146/annurev.biochem.73.012803.092453.
Liu et al., Functional Nucleic Acid Sensors. Chem Rev. May 2009;109(5):1948-98. doi: 10.1021/cr030183i.
Liu et al., Genetic incorporation of unnatural amino acids into proteins in mammalian cells. Nat Methods. Mar. 2007;4(3):239-44. Epub Feb. 25, 2007.
Liu et al., Highly efficient RNA-guided base editing in rabbit. Nat Commun. Jul. 13, 2018;9(1):2717. doi: 10.1038/s41467-018-05232-2.
Liu et al., (6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., Reverse transcriptase of foamy virus. Purification of the enzymes and immunological identification. Arch Virol. 1977;55(3):187-200. doi: 10.1007/BF01319905.
Liu et al., Reverse transcriptase-mediated tropism switching in Bordetella bacteriophage. Science. Mar. 15, 2002;295(5562):2091-4. doi: 10.1126/science.1067467.
Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.
Losey et al., Crystal structure of *Staphylococcus sureus* tRNA adenosine deaminase tadA in complex with RNA. Nature Struct. Mol. Biol. Feb. 2006;13(2):153-9.

(56) References Cited

OTHER PUBLICATIONS

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lynch, Evolution of the mutation rate. Trends Genet. Aug. 2010;26(8):345-52. doi: 10.1016/j.tig.2010.05.003. Epub Jun. 30, 2010.

Lyons et al., Efficient Recognition of an Unpaired Lesion by a DNA Repair Glycosylase. J. Am. Chem. Soc., 2009;131(49):17742-3. DOI: 10.1021/ja908378y.

Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.

Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.

Ma et al., In vitro protein engineering using synthetic tRNA(Ala) with different anticodons. Biochemistry. Aug. 10, 1993;32(31):7939-45.

Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.

Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.

Ma et al., Targeted AID-mediated mutagenesis (TAM) enables efficient genomic diversification in mammalian cells. Nature Methods. Oct. 2016; 13:1029-35. doi:10.1038/nmeth.4027.

Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.

Macbeth et al., Inositol hexakisphosphate is bound in the ADAR2 core and required for RNA editing. Science. Sep. 2, 2005;309(5740):1534-9. doi: 10.1126/science.1113150.

Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.

Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.

Maizels et al., Initiation of homologous recombination at DNA nicks. Nucleic Acids Res. Aug. 21, 2018;46(14):6962-6973. doi: 10.1093/nar/gky588.

Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Classification and Nomenclature of CRISPR-Cas Systems: Where from Here? Crispr J. Oct. 2018;1(5):325-336. doi: 10.1089/crispr.2018.0033.

Makarova et al., Evolution and classification of the CRISPR-Cas systems. Nat Rev Microbiol. Jun. 2011;9(6):467-77. doi: 10.1038/nrmicro2577. Epub May 9, 2011.

Makarova et al., Prokaryotic homologs of Argonaute proteins are predicted to function as key components of a novel system of defense against mobile genetic elements. Biology Direct 2009;4:29. doi: 10.1186/1745-6150-4-29.

Makeyev et al., Evolutionary potential of an RNA virus. J Virol. Feb. 2004;78(4):2114-20.

Malashkevich et al., Crystal structure of tRNA adenosine deaminase TadA from *Escherichia coli*. Deposited: 2005-03-10 Released: Mar. 10, 2006 doi:10.2210/pdb1z3a/pdb (2006).

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.

Mani et al., Design, engineering, and characterization of zinc finger nucleases. Biochem Biophys Res Commun. Sep. 23, 2005;335(2):447-57.

Marceau, Functions of single-strand DNA-binding proteins in DNA replication, recombination, and repair. Methods Mol Biol. 2012;922:1-21. doi: 10.1007/978-1-62703-032-8_1.

Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.

Marioni et al., DNA methylation age of blood predicts all-cause mortality in later life. Genome Biol. Jan. 30, 2015;16:25. doi: 10.1186/s13059-015-0584-6.

Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.

Marraffini et al., CRISPR interference limits horizontal gene transfer in staphylococci by targeting DNA. Science. Dec. 19, 2008;322(5909):1843-5. doi: 10.1126/science.1165771.

Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.

Martsolf et al., Complete trisomy 17p a relatively new syndrome. Ann Genet. 1988;31(3):172-4.

Martz, L., Nav-i-gating antibodies for pain. Science-Business eXchange. Jun. 12, 2014;7(662):1-2. doi: 10.1038/scibx.2014.662.

(56) References Cited

OTHER PUBLICATIONS

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Marzec et al., Prime Editing: A New Way for Genome Editing. Trends Cell Biol. Apr. 2020;30(4):257-259. doi: 10.1016/j.tcb.2020. 01.004. Epub Jan. 27, 2020.

Mascola et al., HIV-1 neutralizing antibodies: understanding nature's pathways. Immunol Rev. Jul. 2013;254(1):225-44. doi: 10.1111/imr. 12075.

Mathys et al., Characterization of a self-splicing mini-intein and its conversion into autocatalytic- and C-terminal cleavage elements: facile production of protein building blocks for protein ligation. Gene. Apr. 29, 1999;231(1-2):1-13. doi: 10.1016/s0378-1119(99)00103-1.

Matsuura et al., A gene essential for the site-specific excision of actinophage r4 prophage genome from the chromosome of a lysogen. J Gen Appl Microbiol. 1995;41(1):53-61.

Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.

May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.

Mccarroll et al., Copy-number variation and association studies of human disease. Nat Genet. Jul. 2007;39(7 Suppl):S37-42. doi: 10.1038/ng2080.

McDonald et al., Characterization of mutations at the mouse phenylalanine hydroxylase locus. Genomics. Feb. 1, 1997;39(3):402-5. doi: 10.1006/geno.1996.4508.

McInerney et al., Error Rate Comparison during Polymerase Chain Reaction by DNA Polymerase. Mol Biol Int. 2014;2014:287430. doi: 10.1155/2014/287430. Epub Aug. 17, 2014.

McKenna et al., Recording development with single cell dynamic lineage tracing. Development. Jun. 27, 2019;146(12):dev169730. doi: 10.1242/dev.169730.

McKenna et al., Whole-organism lineage tracing by combinatorial and cumulative genome editing. Science. Jul. 29, 2016;353(6298):aaf7907. doi: 10.1126/science.aaf7907. Epub May 26, 2016.

McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas. 0807883106. Epub Mar. 23, 2009.

Mead et al., A novel protective prion protein variant that colocalizes with kuru exposure. Engl J Med. Nov. 19, 2009;361(21):2056-65. doi: 10.1056/NEJMoa0809716.

Mei et al., Recent Progress in CRISPR/Cas9 Technology. J Genet Genomics. Feb. 20, 2016;43(2):63-75. doi: 10.1016/j.jgg.2016.01. 001. Epub Jan. 18, 2016.

Meinke et al., Cre Recombinase and Other Tyrosine Recombinases. Chem Rev. Oct. 26, 2016;116(20):12785-12820. doi: 10.1021/acs. chemrev.6b00077. Epub May 10, 2016.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Mertens et al., Site-specific recombination in bacteriophage Mu: characterization of binding sites for the DNA invertase Gin. EMBO J. Apr. 1988;7(4):1219-27.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Meyer et al., Library generation by gene shuffling. Curr Protoc Mol Biol. Jan. 6, 2014;105:Unit 15.12.. doi: 10.1002/0471142727. mb1512s105.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., A TALE nuclease architecture for efficient genome editing. Nat Biotechnol. Feb. 2011;29(2):143-8. doi:10.1038/nbt. 1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.

Miller et al., Phage-assisted continuous and non-continuous evolution. Nat Protoc. Dec. 2020;15(12):4101-4127. doi: 10.1038/s41596-020-00410-3. Epub Nov. 16, 2020.

Miller, Human gene therapy comes of age. Nature. Jun. 11, 1992;357(6378):455-60. doi: 10.1038/357455a0.

Mills et al., Protein splicing in trans by purified- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem. 5b01139. Epub Jan. 9, 2016.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitani et al., Delivering therapeutic genes—matching approach and application. Trends Biotechnol. May 1993;11(5):162-6. doi: 10.1016/0167-7799(93)90108-L.

(56) References Cited

OTHER PUBLICATIONS

Mitton-Fry et al., Poly(A) tail recognition by a viral RNA element through assembly of a triple helix. Science. Nov. 26, 2010;330(6008):1244-7. doi: 10.1126/science.1195858.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 5, 2018;72(4):700-714.e8. doi: 10.1016/j.molcel.2018.09.013. Epub Oct. 18, 2018. Including Supplemental Information.

Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.

Mojica et al., Intervening sequences of regularly spaced prokaryotic repeats derive from foreign genetic elements. J Mol Evol. Feb. 2005;60(2):174-82.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.

Mol et al., Crystal structure of human uracil-DNA glycosylase in complex with a protein inhibitor: protein mimicry of DNA. Cell. Sep. 8, 1995;82(5):701-8.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Monahan et al., Site-specific incorporation of unnatural amino acids into receptors expressed in Mammalian cells. Chem Biol. Jun. 2003;10(6):573-80.

Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Moreno-Mateos et al., CRISPRscan: designing highly efficient sgRNAs for CRISPR-Cas9 targeting in vivo. Nat Methods. Oct. 2015; 12(10):982-8. doi: 10.1038/nmeth.3543. Epub Aug. 31, 2015.

Morita et al., The site-specific recombination system of actinophage TG1. FEMS Microbiol Lett. Aug. 2009;297(2):234-40. doi: 10.1111/j.1574-6968.2009.01683.x.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mougiakos et al., Characterizing a thermostable Cas9 for bacterial genome editing and silencing. Nat Commun. Nov. 21, 2017;8(1):1647. doi: 10.1038/s41467-017-01591-4.

Muir et al., Expressed protein ligation: a general method for protein engineering. Proc Natl Acad Sci U S A. Jun. 9, 1998;95(12):6705-10. doi: 10.1073/pnas.95.12.6705.

Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.

Muller, U.F., Design and Experimental Evolution of trans-Splicing Group I Intron Ribozymes. Molecules. Jan. 2, 2017;22(1):75. doi: 10.3390/molecules22010075.

Mullins et al., Transgenesis in nonmurine species. Hypertension. Oct. 1993;22(4):630-3.

Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.

Murphy, Phage recombinases and their applications. Adv Virus Res. 2012;83:367-414. doi: 10.1016/B978-0-12-394438-2.00008-6. Review.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Muzyczka et al., Adeno-associated virus (AAV) vectors: will they work? J Clin Invest. Oct. 1994;94(4):1351. doi: 10.1172/JCI117468.

Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.

Myers et al., Insulin signal transduction and the IRS proteins. Annu Rev Pharmacol Toxicol. 1996;36:615-58. doi: 10.1146/annurev.pa.36.040196.003151.

Nabel et al., Direct gene transfer for immunotherapy and immunization. Trends Biotechnol. May 1993;11(5):211-5. doi: 10.1016/0167-7799(93)90117-R.

Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.

Nahvi et al., Coenzyme B12 riboswitches are widespread genetic control elements in prokaryotes. Nucleic Acids Res. Jan. 2, 2004;32(1):143-50.

Nakamura et al., Codon usage tabulated from international DNA sequence databases: status for the year 2000. Nucleic Acids Res. Jan. 1, 2000;28(1):292. doi: 10.1093/nar/28.1.292.

Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.

(56) References Cited

OTHER PUBLICATIONS

Nguyen et al., Evolutionary drivers of thermoadaptation in enzyme catalysis. Science. Jan. 20, 2017;355(6322):289-294. doi: 10.1126/science.aah3717. Epub Dec. 22, 2016.

Nguyen et al., IQ-TREE: a fast and effective stochastic algorithm for estimating maximum- likelihood phylogenies. Mol Biol Evol. Jan. 2015;32(1):268-74. doi: 10.1093/molbev/msu300. Epub Nov. 3, 2014.

Ni et al., Nucleic acid aptamers: clinical applications and promising new horizons. Curr Med Chem. 2011;18(27):4206-14. Review.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishikura, Functions and regulation of RNA editing by ADAR deaminases. Annu Rev Biochem. 2010;79:321-349. doi:10.1146/annurev-biochem-060208-105251.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nishimasu et al., Crystal Structure of *Staphylococcus aureus* Cas9. Cell. Aug. 27, 2015;162(5):1113-26. doi: 10.1016/j.cell.2015.08.007.

Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.

Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.

Noris et al., A phenylalanine-55 to serine amino-acid substitution in the human glycoprotein IX leucine-rich repeat is associated with Bernard-Soulier syndrome. Br J Haematol. May 1997;97(2):312-20.

Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.

Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.

Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.

Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.

Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

O'Maille et al., Structure-based combinatorial protein engineering (SCOPE). J Mol Biol. Aug. 23, 2002;321(4):677-91.

Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.

Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.

Oakes et al., Protein engineering of Cas9 for enhanced function. Methods Enzymol. 2014;546:491-511.

Odsbu et al., Specific -terminal interactions of the *Escherichia coli* SeqA protein are required to form multimers that restrain negative supercoils and form foci. Genes Cells. Nov. 2005; 10(11):1039-49.

Oeemig et al., Solution structure of DnaE intein from Nostoc punctiforme: structural basis for the design of a new split intein suitable for site-specific chemical modification. FEBS Lett. May 6, 2009;583(9):1451-6.

Offord, Advances in Genome Editing. The Scientist, Apr. 20, 2016. http://www.the-scientist.com/?articles.view/articleNo/45903/title/Advances-in-Genome-Editing/.

Ohe et al., Purification and properties of xanthine dehydrogenase from Streptomyces cyanogenus. J Biochem. Jul. 1979;86(1):45-53.

Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.

Olorunniji et al., Purification and In Vitro Characterization of Zinc Finger Recombinases. Methods Mol Biol. 2017;1642:229-245. doi: 10.1007/978-1-4939-7169-5_15.

Olorunniji et al., Site-specific recombinases: molecular machines for the Genetic Revolution. Biochem J. Mar. 15, 2016;473(6):673-84. doi: 10.1042/BJ20151112.

Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.

Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.

Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.

Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.

Osborn et al., TALEN-based gene correction for epidermolysis bullosa. Mol Ther. Jun. 2013;21(6):1151-9. doi: 10.1038/mt.2013.56. Epub Apr. 2, 2013.

Ostermeier et al., A combinatorial approach to hybrid enzymes independent of DNA homology. Nat Biotechnol. Dec. 1999;17(12):1205-9.

Ostertag et al., Biology of mammalian L1 retrotransposons. Annu Rev Genet. 2001;35:501-38. doi: 10.1146/annurev.genet.35.102401.091032.

Otomo et al., Improved segmental isotope labeling of proteins and application to a larger protein. J Biomol NMR. Jun. 1999;14(2):105-14. doi: 10.1023/a:1008308128050.

Otomo et al., NMR observation of selected segments in a larger protein: central-segment isotope labeling through intein-mediated ligation. Biochemistry. Dec. 7, 1999;38(49):16040-4. doi: 10.1021/bi991902j.

Otto et al., The probability of fixation in populations of changing size. Genetics. Jun. 1997; 146(2):723-33.

Packer et al., Methods for the directed evolution of proteins. Nat Rev Genet. Jul. 2015;16(7):379-94. doi: 10.1038/nrg3927. Epub Jun. 9, 2015.

Packer et al., Phage-assisted continuous evolution of proteases with altered substrate specificity. Nat Commun. Oct. 16, 2017;8(1):956. doi: 10.1038/s41467-017-01055-9.

Paige et al., RNA mimics of green fluorescent protein. Science. Jul. 29, 2011;333(6042):642-6. doi:10.1126/science.1207339.

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.

Pan et al., Biological and biomedical applications of engineered nucleases. Mol Biotechnol. Sep. 2013;55(1):54-62. doi: 10.1007/s12033-012-9613-9.

Park et al., Digenome-seq web tool for profiling CRISPR specificity. Nat Methods. May 30, 2017;14(6):548-549. doi: 10.1038/nmeth.4262.

(56) References Cited

OTHER PUBLICATIONS

Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.

Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.

Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.

Pattanayak et al., Determining the specificities of TALENs, Cas9, and other genome-editing enzymes. Methods Enzymol. 2014;546:47-78. doi: 10.1016/B978-0-12-801185-0.00003-9.

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pawson et al., Protein phosphorylation in signaling—50 years and counting. Trends Biochem Sci. Jun. 2005;30(6):286-90. doi: 10.1016/j.tibs.2005.04.013.

Pearl, Structure and function in the uracil-DNA glycosylase superfamily. Mutat Res. Aug. 30, 2000;460(3-4):165-81.

Peck et al., Directed evolution of a small-molecule-triggered intein with improved splicing properties in mammalian cells. Chem Biol. May 27, 2011;18(5):619-30. doi: 10.1016/j.chembiol.2011.02.014.

Pellenz et al., New human chromosomal safe harbor sites for genome engineering with CRISPR/Cas9, TAL effector and homing endonucleases. Aug. 20, 2018. bioRxiv doi: https://doi.org/10.1101/396390.

Pelletier, CRISPR-Cas systems for the study of the immune function. Nov. 15, 2016. https://doi.org/10.1002/9780470015902.a0026896.

Pennisi et al., The CRISPR craze. Science. Aug. 23, 2013;341(6148):833-6. doi: 10.1126/science.341.6148.833.

Pennisi et al., The tale of the TALEs. Science. Dec. 14, 2012;338(6113):1408-11. doi: 10.1126/science.338.6113.1408.

Perach et al., Catalytic features of the recombinant reverse transcriptase of bovine leukemia virus expressed in bacteria. Virology. Jun. 20, 1999;259(1):176-89. doi: 10.1006/viro.1999.9761.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Perler et al., Protein splicing and autoproteolysis mechanisms. Curr Opin Chem Biol. Oct. 1997;1(3):292-9. doi: 10.1016/s1367-5931(97)80065-8.

Perler et al., Protein splicing elements: inteins and exteins—a definition of terms and recommended nomenclature. Nucleic Acids Res. Apr. 11, 1994;22(7):1125-7. doi: 10.1093/nar/22.7.1125.

Perler, InBase, the New England Biolabs Intein Database. Nucleic Acids Res. Jan. 1, 1999;27(1):346-7. doi: 10.1093/nar/27.1.346.

Perler, Protein splicing of inteins and hedgehog autoproteolysis: structure, function, and evolution. Cell. Jan. 9, 1998;92(1):1-4. doi: 10.1016/s0092-8674(00)80892-2.

Perreault et al., Mixed deoxyribo- and ribo-oligonucleotides with catalytic activity. Nature. Apr. 5, 1990;344(6266):565-7. doi: 10.1038/344565a0.

Petek et al., Frequent endonuclease cleavage at off-target locations in vivo. Mol Ther. May 2010;18(5):983-6. Doi: 10.1038/mt.2010.35. Epub Mar. 9, 2010.

Petersen-Mahrt et al., AID mutates *E. coli* suggesting a DNA deamination mechanism for antibody diversification. Nature. Jul. 4, 2002;418(6893):99-103.

Petolino et al., Editing Plant Genomes: a new era of crop improvement. Plant Biotechnol J. Feb. 2016;14(2):435-6. doi: 10.1111/pbi.12542.

Peyrottes et al., Oligodeoxynucleoside phosphoramidates (P-NH2): synthesis and thermal stability of duplexes with DNA and RNA targets. Nucleic Acids Res. May 15, 1996;24(10):1841- 8.

Phillips, The challenge of gene therapy and DNA delivery. J Pharm Pharmacol. Sep. 2001;53(9):1169-74.

Pickart et al., Ubiquitin: structures, functions, mechanisms. Biochim Biophys Acta. Nov. 29, 2004;1695(1-3):55-72. doi: 10.1016/j.bbamcr.2004.09.019.

Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.

Pirakitikulr et al., PCRless library mutagenesis via oligonucleotide recombination in yeast. Protein Sci. Dec. 2010;19(12):2336-46. doi: 10.1002/pro.513.

Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.

Plosky et al., CRISPR-Mediated Base Editing without DNA Double-Strand Breaks. Mol Cell. May 19, 2016;62(4):477-8. doi: 10.1016/j.molcel.2016.05.006.

Pluciennik et al., PCNA function in the activation and strand direction of MutL? endonuclease in mismatch repair. Proc Natl Acad Sci U S A. Sep. 14, 2010;107(37):16066-71. doi: 10.1073/pnas.1010662107. Epub Aug. 16, 2010.

Poller et al., A leucine-to-proline substitution causes a defective alpha 1-antichymotrypsin allele associated with familial obstructive lung disease. Genomics. Sep. 1993;17(3):740-3.

Popp et al., Sortagging: a versatile method for protein labeling. Nat Chem Biol. Nov. 2007;3(11):707-8. doi: 10.1038/nchembio.2007.31. Epub Sep. 23, 2007.

Porteus, Design and testing of zinc finger nucleases for use in mammalian cells. Methods Mol Biol. 2008;435:47-61. doi: 10.1007/978-1-59745-232-8_4.

Posnick et al., Imbalanced base excision repair increases spontaneous mutation and alkylation sensitivity in *Escherichia coli*. J Bacteriol. Nov. 1999;181(21):6763-71.

Pospísilová et al., Hydrolytic cleavage of N6-substituted adenine derivatives by eukaryotic adenine and adenosine deaminases. Biosci Rep. 2008;28(6):335-347. doi:10.1042/BSR20080081.

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Pruschy et al., Mechanistic studies of a signaling pathway activated by the organic dimerizer FK1012. Chem Biol. Nov. 1994;1(3):163-72. doi: 10.1016/1074-5521(94)90006-x.

(56) References Cited

OTHER PUBLICATIONS

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.
Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.
Raillard et al., Targeting sites within HIV-1 cDNA with a DNA-cleaving ribozyme. Biochemistry. Sep. 10, 1996;35(36):11693-701. doi: 10.1021/bi960845g.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Rakonjac et al., Roles of PIII in filamentous phage assembly. J Mol Biol. 1998; 282(1)25-41.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramamurthy et al., Identification of immunogenic B-cell epitope peptides of rubella virus E1 glycoprotein towards development of highly specific immunoassays and/or vaccine. Conference Abstract. 2019.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 Rna polymerase mutants with altered promoter specificities. Proc Natl Acad Sci U S A. Apr. 15, 1993;90(8):3147-51.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Ray et al., A compendium of RNA-binding motifs for decoding gene regulation. Nature. Jul. 11, 2013;499(7457):172-7. doi: 10.1038/nature12311.
Ray et al., Homologous recombination: ends as the means. Trends Plant Sci. Oct. 2002;7(10):435-40.
Rebar et al., Phage display methods for selecting zinc finger proteins with novel DNA-binding specificities. Methods Enzymol. 1996;267:129-49.
Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Rees et al., Improving the DNA specificity and applicability of base editing through protein engineering and protein delivery. Nat Commun. Jun. 6, 2017;8:15790. doi: 10.1038/ncomms15790.
Relph et al., Recent developments and current status of gene therapy using viral vectors in the United Kingdom. BMJ. 2004;329(7470):839-842. doi:10.1136/bmj.329.7470.839.
Remy et al., Gene transfer with a series of lipophilic DNA-binding molecules. Bioconjug Chem. Nov.-Dec. 1994;5(6):647-54. doi: 10.1021/bc00030a021.
Ren et al., In-line Alignment and $Mg^{2}$? Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., Flash assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Riechmann et al., The C-terminal domain of TolA is the coreceptor for filamentous phage infection of *E. coli*. Cell. 1997; 90(2):351-60. PMID:9244308.
Ringrose et al., The Kw recombinase, an integrase from Kluyveromyces waltii. Eur J Biochem. Sep. 15, 1997;248(3):903-12. doi: 10.1111/j.1432-1033.1997.00903.x.

(56) References Cited

OTHER PUBLICATIONS

Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robertson et al., DNA repair in mammalian cells: Base excision repair: the long and short of it. Cell Mol Life Sci. Mar. 2009;66(6):981-93. doi: 10.1007/s00018-009-8736-z.
Robertson et al., Selection in vitro of an RNA enzyme that specifically cleaves single-stranded DNA. Nature. Mar. 29, 1990;344(6265):467-8. doi: 10.1038/344467a0.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013; 159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.

Rüfer et al., Non-contact positions impose site selectivity on Cre recombinase. Nucleic Acids Res. Jul. 1, 2002;30(13):2764-71. doi: 10.1093/nar/gkf399.
Sadelain et al., Safe harbours for the integration of new DNA in the human genome. Nat Rev Cancer. Dec. 1, 2011;12(1):51-8. doi: 10.1038/nrc3179.
Sage et al., Proliferation of functional hair cells in vivo in the absence of the retinoblastoma protein. Science. Feb. 18, 2005;307(5712):1114-8. Epub Jan. 13, 2005.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samanta et al., A reverse transcriptase ribozyme. Elife. Sep. 26, 2017;6:e31153. doi: 10.7554/eLife.31153.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

(56) References Cited

OTHER PUBLICATIONS

Sasidharan et al., The selection of acceptable protein mutations. PNAS; Jun. 12, 2007;104(24):10080-5. www.pnas.org/cgi/doi/10.1073.pnas.0703737104.

Satomura et al., Precise genome-wide base editing by the CRISPR Nickase system in yeast. Sci Rep. May 18, 2017;7(1):2095. doi: 10.1038/s41598-017-02013-7.

Saudek et al., A preliminary trial of the programmable implantable medication system for insulin delivery. Engl J Med. Aug. 31, 1989;321(9):574-9.

Sauer et al., DNA recombination with a heterospecific Cre homolog identified from comparison of the pac-cl regions of P1-related phages. Nucleic Acids Res. Nov. 18, 2004;32(20):6086-95. doi: 10.1093/nar/gkh941.

Savic et al., Covalent linkage of the DNA repair template to the CRISPR-Cas9 nuclease enhances homology-directed repair. Elife. May 29, 2018;7:e33761. doi: 10.7554/eLife.33761.

Saville et al., A site-specific self-cleavage reaction performed by a novel RNA in Neurospora mitochondria. Cell. May 18, 1990;61(4):685-96. doi: 10.1016/0092-8674(90)90480-3.

Savva et al., The structural basis of specific base-excision repair by uracil-DNA glycosylase. Nature. Feb. 9, 1995;373(6514):487-93. doi: 10.1038/373487a0.

Schaaper et al., Base selection, proofreading, and mismatch repair during DNA replication in *Escherichia coli*. J Biol Chem. Nov. 15, 1993;268(32):23762-5.

Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.

Schaefer et al., Understanding RNA modifications: the promises and technological bottlenecks of the 'epitranscriptome'. Open Biol. May 2017;7(5):170077. doi: 10.1098/rsob.170077.

Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.

Schenk et al., MPDU1 mutations underlie a novel human congenital disorder of glycosylation, designated type If. J Clin Invest. Dec. 2001; 108(11):1687-95. doi: 10.1172/JCI13419.

Schmitz et al., Behavioral abnormalities in prion protein knockout mice and the potential relevance of PrP(C) for the cytoskeleton. Prion. 2014;8(6):381-6. doi: 10.4161/19336896.2014.983746.

Schriefer et al., Low pressure DNA shearing: a method for random DNA sequence analysis. Nucleic Acids Res. Dec. 25, 1990;18(24):7455-6.

Schultz et al., Expression and secretion in yeast of a 400-kDa envelope glycoprotein derived from Epstein-Barr virus. Gene. 1987;54(1):113-23. doi: 10.1016/0378-1119(87)90353-2.

Schultz et al., Oligo-2'-fluoro-2'-deoxynucleotide N3' →P5' phosphoramidates: synthesis and properties. Nucleic Acids Res. Aug. 1, 1996;24(15):2966-73.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Schwartz et al., Post-translational enzyme activation in an animal via optimized conditional protein splicing. Nat Chem Biol. Jan. 2007;3(1):50-4. Epub Nov. 26, 2006.

Schwarze et al., In vivo protein transduction: delivery of a biologically active protein into the mouse. Science. Sep. 3, 1999;285(5433):1569-72.

Sclimenti et al., Directed evolution of a recombinase for improved genomic integration at a native human sequence. Nucleic Acids Res. Dec. 15, 2001;29(24):5044-51.

SCORE Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.

SCORE Results for Okumura et al., Evolutionary paths of streptococcal and staphylococcal superantigens. RL BMC Genomics. 2012;13:404-404. 3 pages.

Scott et al., Production of cyclic peptides and proteins in vivo. Proc Natl Acad Sci U S A. Nov. 23, 1999;96(24):13638-43. doi: 10.1073/pnas.96.24.13638.

Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.

Seed, An LFA-3 cDNA encodes a phospholipid-linked membrane protein homologous to its receptor CD2. Nature. Oct. 29-Nov. 4, 1987-;329(6142):840-2. doi: 10.1038/329840a0.

Sefton et al., Implantable pumps. Crit Rev Biomed Eng. 1987;14(3):201-40.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Sells et al., Delivery of protein into cells using polycationic liposomes. Biotechniques. Jul. 1995;19(1):72-6, 78.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Semple et al., Rational design of cationic lipids for siRNA delivery. Nat Biotechnol. Feb. 2010;28(2):172-6. doi: 10.1038/nbt.1602. Epub Jan. 17, 2010.

Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

Serganov et al., Structural basis for discriminative regulation of gene expression by adenine- and guanine-sensing mRNAs. Chem Biol. Dec. 2004;11(12):1729-41.

Serganov et al., Structural basis for gene regulation by a thiamine pyrophosphate-sensing riboswitch. Nature. Jun. 2, 20069;441(7097):1167-71. Epub May 21, 2006.

Seripa et al., The missing ApoE allele. Ann Hum Genet. Jul. 2007;71(Pt 4):496-500. Epub Jan. 22, 2007.

Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.

Setten et al., The current state and future directions of RNAi-based therapeutics. Nat Rev Drug Discov. Jun. 2019;18(6):421-446. doi: 10.1038/s41573-019-0017-4.

Severinov et al., Expressed protein ligation, a novel method for studying protein-protein interactions in transcription. J Biol Chem. Jun. 26, 1998;273(26):16205-9. doi: 10.1074/jbc.273.26.16205.

Sha et al., Monobodies and other synthetic binding proteins for expanding protein science. Protein Sci. May 2017;26(5):910-924. doi: 10.1002/pro.3148. Epub Mar. 24, 2017.

Shah et al., Inteins: nature's gift to protein chemists. Chem Sci. 2014;5(1):446-461.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shah et al., Protospacer recognition motifs: mixed identities and functional diversity. RNA Biol. May 2013;10(5):891-9. doi: 10.4161/rna.23764. Epub Feb. 12, 2013.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Shaikh et al., Chimeras of the Flp and Cre recombinases: tests of the mode of cleavage by Flp and Cre. J Mol Biol. Sep. 8, 2000;302(1):27-48.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

(56) References Cited

OTHER PUBLICATIONS

Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 2, 20180.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.
Shee et al., Engineered proteins detect spontaneous DNA breakage in human and bacterial cells. Elife. Oct. 29, 2013;2:e01222. doi: 10.7554/eLife.01222.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi- sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-β complex by the umuD gene products. Nucleic Acids Res. Jul. 2012;40(12):5511-22. doi: 10.1093/nar/gks229. Epub Mar. 9, 2012.
Simonelli et al., Base excision repair intermediates are mutagenic in mammalian cells. Nucleic Acids Res. Aug. 2, 2005;33(14):4404-11. Print 2005.
Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sjoblom et al., The consensus coding sequences of human breast and colorectal cancers. Science. Oct. 13, 2006;314(5797):268-74. Epub Sep. 7, 2006.
Skretas et al., Regulation of protein activity with small-molecule-controlled inteins. Protein Sci. Feb. 2005;14(2):523-32. Epub Jan. 4, 2005.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Diversity in the serine recombinases. Mol Microbiol. Apr. 2002;44(2):299-307. Review.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Sommerfelt et al., Receptor interference groups of 20 retroviruses plating on human cells. Virology. May 1990;176(1):58-69. doi: 10.1016/0042-6822(90)90230-o.

(56) References Cited

OTHER PUBLICATIONS

Song et al., Delivery of CRISPR/Cas systems for cancer gene therapy and immunotherapy. Adv Drug Deliv Rev. Jan. 2021; 168:158-180. doi: 10.1016/j.addr.2020.04.010. Epub May 1, 2020.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi gyrase* A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Steiner et al., The neurotropic herpes viruses: herpes simplex and varicella-zoster. Lancet Neurol. Nov. 2007;6(11):1015-28. doi: 10.1016/S1474-4422(07)70267-3.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Stenson et al., Human Gene Mutation Database: towards a comprehensive central mutation database. J Med Genet. Feb. 2008;45(2):124-6. doi:10.1136/jmg.2007.055210.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Stephens et al., The landscape of cancer genes and mutational processes in breast cancer. Nature Jun. 2012;486:400-404. doi: 10.1038/nature11017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.

Strecker et al., Engineering of CRISPR-Cas12b for human genome editing. Nat Commun. Jan. 22, 2019;10(1):212. doi: 10.1038/s41467-018-08224-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Sudarsan et al., An mRNA structure in bacteria that controls gene expression by binding lysine. Genes Dev. Nov. 1, 2003;17(21):2688-97.
Sudarsan et al., Riboswitches in eubacteria sense the second messenger cyclic di-GMP. Science. Jul. 18, 2008;321(5887):411-3. doi: 10.1126/science.1159519.
Suess et al., A theophylline responsive riboswitch based on helix slipping controls gene expression in vivo. Nucleic Acids Res. Mar. 5, 2004;32(4):1610-4.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sullenger et al., Ribozyme-mediated repair of defective mRNA by targeted, trans-splicing. Nature. Oct. 13, 1994;371(6498):619-22. doi: 10.1038/371619a0.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.

(56) References Cited

OTHER PUBLICATIONS

Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar. 2002-Apr;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 20156. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.

(56) References Cited

OTHER PUBLICATIONS

Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2): 193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UNIPROT Submission; UniProt, Accession No. P01011. Last modified Jun. 11, 2014, version 2. 15 pages.
UNIPROT Submission; UniProt, Accession No. P01011. Last modified Sep. 18, 2013, version 2. 15 pages.
UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
UniProtein A0A1V6. Dec. 11, 2019.
UNIPROTKB Submission; Accession No. F0NH53. May 3, 2011. 4 pages.
UNIPROTKB Submission; Accession No. F0NN87. May 3, 2011. 4 pages.
UNIPROTKB Submission; Accession No. G3ECR1.2. No Author Listed., Aug. 12, 2020, 8 pages.
UNIPROTKB Submission; Accession No. P0DOC6. No Author Listed., Oct. 5, 2016. 5 pages.
UNIPROTKB Submission; Accession No. T0D7A2. Oct. 16, 2013. 10 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Usman et al., Exploiting the chemical synthesis of RNA. Trends Biochem Sci. Sep. 1992;17(9):334-9. doi: 10.1016/0968-0004(92)90306-t.
Vagner et al., Efficiency of homologous DNA recombination varies along the Bacillus subtilis chromosome. J Bacteriol. Sep. 1988;170(9):3978-82.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Biotechniques. 2015:59,201-2;204;206-8.
Wang et al., (6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.

(56) References Cited

OTHER PUBLICATIONS

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of (6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci USA. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLoS One. 2011;6(5):e19722. doi: 10.1371/journal.pone.0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using DISCOVER-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 20178.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374- 2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 201599;348(6241):1376-81. doi 9:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.

(56) References Cited

OTHER PUBLICATIONS

Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.

Wolf et al., tadA, an essential tRNA-specific adenosine deaminase from *Escherichia coli*. EMBO J. Jul. 15, 2002;21(14):3841-51.

Wolfe et al., Analysis of zinc fingers optimized via phage display: evaluating the utility of a recognition code. J Mol Biol. Feb. 5, 1999;285(5):1917-34.

Wong et al., A statistical analysis of random mutagenesis methods used for directed protein evolution. J Mol Biol. Jan. 27, 2006;355(4):858-71. Epub Nov. 17, 2005.

Wong et al., The Diversity Challenge in Directed Protein Evolution. Comb Chem High Throughput Screen. May 2006;9(4):271-88.

Wood et al., A genetic system yields self-cleaving inteins for bioseparations. Nat Biotechnol. Sep. 1999;17(9):889-92. doi: 10.1038/12879.

Wood et al., Targeted genome editing across species using ZFNs and TALENs. Science. Jul. 15, 2011;333(6040):307. doi: 10.1126/science.1207773. Epub Jun. 23, 2011.

Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.

Wright et al., Continuous in vitro evolution of catalytic function. Science. Apr. 25, 1997;276(5312):614-7.

Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.

Wu et al., Correction of a genetic disease in mouse via use of CRISPR-Cas9. Cell Stem Cell. Dec. 5, 2013;13(6):659-62. doi: 10.1016/j.stem.2013.10.016.

Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.

Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.

Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.

Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.

Xiang et al., RNA m6A methylation regulates the ultraviolet-induced DNA damage response. Nature. Mar. 23, 2017;543(7646):573-576. doi: 10.1038/nature21671. Epub Mar. 15, 2017.

Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.

Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.

Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.

Xiong et al., Origin and evolution of retroelements based upon their reverse transcriptase sequences. EMBO J. Oct. 1990;9(10):3353-62.

Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.

Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.

Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.

Xu et al., Protein splicing: an analysis of the branched intermediate and its resolution by succinimide formation. EMBO J. Dec. 1, 1994;13(23):5517-22.

Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.

Xu et al., Sequence determinants of improved CRISPR sgRNA design. Genome Res. Aug. 2015;25(8):1147-57. doi: 10.1101/gr.191452.115. Epub Jun. 10, 2015.

Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.

Xu et al., The mechanism of protein splicing and its modulation by mutation. EMBO J. Oct. 1, 1996;15(19):5146-53.

Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.

Yamamoto et al., The ons and offs of inducible transgenic technology: a review. Neurobiol Dis. Dec. 2001;8(6):923-32.

Yamamoto et al., Virological and immunological bases for HIV-1 vaccine design. Uirusu 2007;57(2):133-139. https://doi.org/10.2222/jsv.57.133.

Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.

Yamano et al., Crystal Structure of Cpf1 in Complex with Guide RNA and Target DNA. Cell. May 5, 2016;165(4):949-62. doi: 10.1016/j.cell.2016.04.003. Epub Apr. 21, 2016.

Yamazaki et al., Segmental Isotope Labeling for Protein NMR Using Peptide Splicing. J. Am. Chem. Soc. May 22, 1998; 120(22):5591-2. https://doi.org/10.1021/ja9807760.

Yan et al., Cas13d Is a Compact RNA-Targeting Type VI Crispr Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yan et al., Functionally diverse type V CRISPR-Cas systems. Science. Jan. 4, 2019;363(6422):88-91. doi: 10.1126/science.aav7271. Epub Dec. 6, 2018.

Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.

Yang et al., APOBEC: From mutator to editor. J Genet Genomics. Sep. 20, 2017;44(9):423-437. doi: 10.1016/j.jgg.2017.04.009. Epub Aug. 7, 2017.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., New CRISPR-Cas systems discovered. Cell Res. Mar. 2017;27(3):313-314. doi: 10.1038/cr.2017.21. Epub Feb. 21, 2017.

Yang et al., One Prime for All Editing. Cell. Dec. 12, 2019;179(7):1448-1450. doi: 10.1016/j.cell.2019.11.030.

(56) References Cited

OTHER PUBLICATIONS

Yang et al., PAM-dependent Target DNA Recognition and Cleavage by C2C1 CRISPR-Cas endonuclease. Cell Dec. 2016;167(7):1814-28.
Yang et al., Permanent genetic memory with >1-byte capacity. Nat Methods. Dec. 2014;11(12):1261-6. doi: 10.1038/nmeth.3147. Epub Oct. 26, 2014.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yang et al., Small-molecule control of insulin and PDGF receptor signaling and the role of membrane attachment. Curr Biol. Jan. 1, 1998;8(1):11-8. doi: 10.1016/s0960-9822(98)70015-6.
Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.
Yang, Nucleases: diversity of structure, function and mechanism. Q Rev Biophys. Feb. 2011;44(1):1-93. doi: 10.1017/S0033583510000181. Epub Sep. 21, 2010.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Yasui, Alternative excision repair pathways. Cold Spring Harb Perspect Biol. Jun. 1, 2013;5(6):a012617. doi: 10.1101/cshperspect.a012617.
Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.
Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.
Zelphati et al., Intracellular delivery of proteins with a new lipid-mediated delivery system. J Biol Chem. Sep. 14, 2001;276(37):35103-10. Epub Jul. 10, 2001.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zetsche et al., A split-Cas9 architecture for inducible genome editing and transcription modulation. Nat Biotechnol. Feb. 2015;33(2):139-42. doi: 10.1038/nbt.3149.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.
Zhang et al., Π-Clamp-mediated cysteine conjugation. Nat Chem. Feb. 2016;8(2):120-8. doi: 10.1038/nchem.2413. Epub Dec. 21, 2015.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhang et al., Ribozymes and Riboswitches: Modulation of RNA Function by Small Molecules. Biochemistry. Nov. 2, 2010;49(43):9123-31. doi: 10.1021/bi1012645.
Zhang et al., Stabilized plasmid-lipid particles for regional gene therapy: formulation and transfection properties. Gene Ther. Aug. 1999;6(8):1438-47.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.
Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

(56) References Cited

OTHER PUBLICATIONS

Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zheng et al., Highly efficient base editing in bacteria using a Cas9-cytidine deaminase fusion. Commun Biol. Apr. 19, 2018;1:32. doi: 10.1038/s42003-018-0035-5.
Zheng et al., Structural basis for the complete resistance of the human prion protein mutant G127V to prion disease. Sci Rep. Sep. 4, 2018;8(1):13211. doi: 10.1038/s41598-018-31394-6.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zhou et al., Dynamic m(6)A mRNA methylation directs translational control of heat shock response. Nature. Oct. 22, 2015;526(7574):591-4. doi: 10.1038/nature15377. Epub Oct. 12, 2015.
Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.
Zhou et al., Protective V127 prion variant prevents prion disease by interrupting the formation of dimer and fibril from molecular dynamics simulations. Sci Rep. Feb. 24, 2016;6:21804. doi: 10.1038/srep21804.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Zielenski, Genotype and phenotype in cystic fibrosis. Respiration. 2000;67(2):117-33. doi: 10.1159/000029497.
Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.
Zimmerly et al., Group II intron mobility occurs by target DNA-primed reverse transcription. Cell. Aug. 25, 1995;82(4):545-54. doi: 10.1016/0092-8674(95)90027-6.
Zimmermann et al., Molecular interactions and metal binding in the theophylline-binding core of an RNA aptamer. RNA. May 2000;6(5):659-67.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.
Zuker et al., Optimal computer folding of large RNA sequences using thermodynamics and auxiliary information. Nucleic Acids Res. Jan. 10, 1981;9(1):133-48. doi: 10.1093/nar/9.1.133.
Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.
Zuris et al., Cationic lipid-mediated delivery of proteins enables efficient protein-based genome editing in vitro and in vivo. Nat Biotechnol. 2015;33:73-80.
U.S. Appl. No. 61/874,682, filed Sep. 6, 2013, Liu et al.
U.S. Appl. No. 61/874,746, filed Sep. 6, 2013, Liu et al.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Arbab et al., Cloning-free CRISPR. Stem Cell Reports. Nov. 10, 2015;5(5):908-917. doi: 10.1016/j.stemcr.2015.09.022. Epub Oct. 29, 2015.
Bae et al., Microhomology-based choice of Cas9 nuclease target sites. Nat Methods. Jul. 2014;11(7):705-6. doi: 10.1038/nmeth.3015.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Christian et al., Targeting DNA double-strand breaks with TAL effector nucleases. Genetics. Oct. 2010;186(2):757-61. Doi: 10.1534/genetics.110.120717. Epub Jul. 26, 2010.
Chu et al., Increasing the efficiency of homology-directed repair for CRISPR-Cas9-induced precise gene editing in mammalian cells. Nat Biotech. Feb. 13, 2015;33:543-8.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cong et al., Multiplex genome engineering using CRISPR/Cas systems. Science. Feb. 15, 2013;339(6121):819-23. doi: 10.1126/science.1231143. Epub Jan. 3, 2013.
Cornu et al., Refining strategies to translate genome editing to the clinic. Nat Med. Apr. 3, 2017;23(4):415-423. doi: 10.1038/nm.4313.
Davis et al., DNA double strand break repair via non-homologous end-joining. Transl Cancer Res. Jun. 2013;2(3):130-143. doi: 10.3978/j.issn.2218-676X.2013.04.02.
Deltcheva et al., CRISPR RNA maturation by trans-encoded small RNA and host factor RNase III. Nature. Mar. 31, 2011;471(7340):602-7. doi: 10.1038/nature09886.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Dicarlo et al., Genome engineering in *Saccharomyces cerevisiae* using CRISPR-Cas systems. Nucleic Acids Research Apr. 2013;41(7):4336-43.
Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Doench et al., Optimized sgRNA design to maximize activity and minimize off-target effects of CRISPR-Cas9. Nat Biotechnol. Feb. 2016;34(2):184-191. doi: 10.1038/nbt.3437.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Heidenreich et al., Non-homologous end joining as an important mutagenic process in cell cycle-arrested cells. EMBO J. May 1, 2003;22(9):2274-83. doi: 10.1093/emboj/cdg203.
Hu et al., Evolved Cas9 variants with broad PAM compatibility and high DNA specificity. Nature. Apr. 5, 2018;556(7699):57-63. doi: 10.1038/nature26155. Epub Feb. 28, 2018.
Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.
Invitation to Pay Additional Fees mailed Mar. 8, 2019 in connection with PCT/US2018/065886.
International Search Report and Written Opinion mailed Apr. 25, 2019 in connection with PCT/US2018/065886.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

(56) References Cited

OTHER PUBLICATIONS

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Kim et al., Hybrid restriction enzymes: zinc finger fusions to Fok I cleavage domain. Proc Natl Acad Sci U S A. Feb. 6, 1996;93(3):1156-60. doi: 10.1073/pnas.93.3.1156.

Kim et al., In vivo high-throughput profiling of CRISPR-Cpf1 activity. Nat Methods. Feb. 2017;14(2):153-159. doi: 10.1038/nmeth.4104. Epub Dec. 19, 2016.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.

Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.

Komor et al., Programmable editing of a target base in genomic DNA without double-stranded DNA cleavage. Nature. Apr. 20, 2016;533(7603):420-4. doi: 10.1038/nature17946.

Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Mali et al., Cas9 as a versatile tool for engineeringbiology. Nat Methods. Oct. 2013; 10(10):957-63. doi: 10.1038/nmeth.2649.

Mali et al., RNA-guided human genome engineering via Cas9. Science. Feb. 15, 2013;339(6121):823-6. doi: 10.1126/science.1232033. Epub Jan. 3, 2013.

Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.

McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.

Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.

Oh et al., Positional cloning of a gene for Hermansky-Pudlak syndrome, a disorder of cytoplasmic organelles. Nat Genet. Nov. 1996;14(3):300-6. doi: 10.1038/ng1196-300.

Orthwein et al., A mechanism for the suppression of homologous recombination in G1 cells. Nature. Dec. 17, 2015;528(7582):422-6. doi: 10.1038/nature16142. Epub Dec. 9, 2015.

Paquet et al., Efficient introduction of specific homozygous and heterozygous mutations using CRISPR/Cas9. Nature. May 5, 2016;533(7601): 125-9. doi: 10.1038/nature17664. Epub Apr. 27, 2016.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.

Shalem et al., High-throughput functional genomics using CRISPR-Cas9. Nat Rev Genet. May 2015;16(5):299-311. doi: 10.1038/nrg3899. Epub Apr. 9, 2015.

Shen et al., Predictable and precise template-free CRISPR editing of pathogenic variants. Nature. Nov. 2018;563(7733):646-651. doi: 10.1038/s41586-018-0686-x. Epub Nov. 7, 2018. Erratum in: Nature. Mar. 2019;567(7746):E1-E2.

Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.

Shin et al., CRISPR/Cas9 targeting events cause complex deletions and insertions at 17 sites in the mouse genome. Nat Commun. May 31, 2017;8:15464. doi: 10.1038/ncomms15464.

Slaymaker et al., Rationally engineered Cas9 nucleases with improved specificity. Science. Jan. 1, 2016;351(6268):84-8. doi: 10.1126/science.aad5227. Epub Dec. 1, 2015.

Sterne-Weiler et al., Exon identity crisis: disease-causing mutations that disrupt the splicing code. Genome Biol. Jan. 23, 2014;15(1):201. doi: 10.1186/gb4150.

Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017. PMID: 29499925; PMCID: PMC5723376.

Suzuki et al., In vivo genome editing via CRISPR/Cas9 mediated homology-independent targeted integration. Nature. Dec. 1, 2016;540(7631): 144-149. doi: 10.1038/nature20565. Epub Nov. 16, 2016.

Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.

Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

[No Author Listed], "Lambda DNA" from Catalog & Technical Reference. New England Biolabs Inc. 2002/2003. pp. 133 and 270-273.

[No Author Listed], *Mus musculus* (Mouse). UniProtKB Accession No. P51908 (ABEC1_MOUSE). Oct. 1, 1996. 10 pages.

Asokan et al., The AAV vector toolkit: poised at the clinical crossroads. Mol Ther. Apr. 2012;20(4):699-708. doi: 10.1038/mt.2011.287. Epub Jan. 24, 2012.

Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.

Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.

Badran et al., In vivo continuous directed evolution. Curr Opin Chem Biol. Feb. 2015;24:1-10. doi: 10.1016/j.cbpa.2014.09.040. Epub Nov. 7, 2014.

Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.

(56) References Cited

OTHER PUBLICATIONS

Bass, B.L., RNA editing by adenosine deaminases that act on RNA. Annu Rev Biochem. 2002;71:817-46. doi: 10.1146/annurev.biochem.71.110601.135501. Epub Nov. 9, 2001.
Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Brierley et al., Viral RNA pseudoknots: versatile motifs in gene expression and replication. Nat Rev Microbiol. Aug. 2007;5(8):598-610. doi: 10.1038/nrmicro1704.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Chatterjee et al., Robust Genome Editing of Single-Base PAM Targets; with Engineered ScCas9 Variants. bioRxiv. doi: 10.1101/620351. Posted Apr. 26, 2019.
Chen et al., Alterations in PMS2, MSH2 and MLH1 expression in human prostate cancer. Int J Oncol. May 2003;22(5):1033-43.
Choudhury et al., CRISPR/Cas9 recombineering-mediated deep mutational scanning of essential genes in *Escherichia coli*. Mol Syst Biol. Mar. 2020; 16(3):e9265. doi: 10.15252/msb.20199265.
Davis et al., Assaying Repair at DNA Nicks. Methods Enzymol. 2018;601:71-89. doi: 10.1016/bs.mie.2017.12.001. Epub Feb. 1, 2018.
Davis et al., Homology-directed repair of DNA nicks via pathways distinct from canonical double-strand break repair. Proc Natl Acad Sci U S A. Mar. 12, 2014;111(10):E924-32. doi: 10.1073/pnas.1400236111. Epub Feb. 20, 2014.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Eisenberg et al., A-to-I RNA editing—immune protector and transcriptome diversifier. Nat Rev Genet. Aug. 2018; 19(8):473-490. doi: 10.1038/s41576-018-0006-1.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Friedman, J. H., Greedy function approximation: A gradient boosting machine. Ann. Statist. Oct. 2001;29(5):1189-232. doi: 10.1214/aos/1013203451.
GENBANK Submission; NIH/NCBI, Accession No. NG_008692.2. McClintock et al., Aug. 27, 2018. 33 pages.
GENBANK Submission; NIH/NCBI, Accession No. NP_001075493.1. Schiaffella et al., Jun. 24, 2018. 2 pages.
GENBANK Submission; NIH/NCBI, Accession No. NP_001157741.1. Zeng et al., Sep. 17, 2018. 3 pages.
GENBANK Submission; NIH/NCBI, Accession No. NP_001157742.1. Zeng et al., Oct. 21, 2018. 3 pages.
GENBANK Submission; NIH/NCBI, Accession No. NP_033040.2. Liu et al., Jun. 23, 2018. 2 pages.
GENBANK Submission; NIH/NCBI, Accession No. XP_003314669.1. No Author Listed, Mar. 20, 2018. 2 pages.
GENBANK Submission; NIH/NCBI, Accession No. XP_026671085.1. No Author Listed, Oct. 17, 2018. 1 page.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hardt et al., Missense variants in hMLH1 identified in patients from the German HNPCC consortium and functional studies. Fam Cancer. Jun. 2011;10(2):273-84. doi: 10.1007/s10689-011-9431-4.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.
Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Isaacs et al., Engineered riboregulators enable post-transcriptional control of gene expression. Nat Biotechnol. Jul. 2004;22(7):841-7. doi: 10.1038/nbt986. Epub Jun. 20, 2004.
Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.
Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
Knott et al., CRISPR-Cas guides the future of genetic engineering. Science. Aug. 31, 2018;361(6405):866-869. doi: 10.1126/science.aat5011.
Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Liao et al., One-step assembly of large CRISPR arrays enables multi-functional targeting and reveals constraints on array design. bioRxiv. May 2, 2018. doi: 10.1101/312421. 45 pages.
Lin et al., [Construction and evaluation of DnaB split intein high expression vector and a six amino acids cyclic peptide library]. Sheng Wu Gong Cheng Xue Bao. Nov. 2008;24(11):1924-30. Chinese.

(56) References Cited

OTHER PUBLICATIONS

Lindahl, T., Instability and decay of the primary structure of DNA. Nature. Apr. 22, 1993;362(6422):709-15. doi: 10.1038/362709a0.
Liu et al., Human BRCA2 protein promotes RAD51 filament formation on RPA-covered single-stranded DNA. Nat Struct Mol Biol. Oct. 2010; 17(10):1260-2. doi: 10.1038/nsmb.1904. Epub Aug. 22, 2010.
Liu et al., Improving Editing Efficiency for the Sequences with NGH PAM Using xCas9- Derived Base Editors. Mol Ther Nucleic Acids. Sep. 6, 2019;17:626-635. doi: 10.1016/j.omtn.2019.06.024. Epub Jul. 12, 2019.
Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.
Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.
Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.
Mootz et al., Protein splicing triggered by a small molecule. J Am Chem Soc. Aug. 7, 2002;124(31):9044-5 and Supporting Information. doi: 10.1021/ja0267690. 4 pages.
Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.
Nelson et al., The unstable repeats—three evolving faces of neurological disease. Neuron. Mar. 6, 2013;77(5):825-43. doi: 10.1016/j.neuron.2013.02.022.
Noack et al., Epitranscriptomics: A New Regulatory Mechanism of Brain Development and Function. Front Neurosci. Feb. 20, 2018;12:85. doi: 10.3389/fnins.2018.00085. 9 pages.
Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.
Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.
Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.
Rajagopal et al., High-throughput mapping of regulatory DNA. Nat Biotechnol. Feb. 2016;34(2):167-74. doi: 10.1038/nbt.3468. Epub Jan. 25, 2016.
Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.
Richardson et al., Frequent chromosomal translocations induced by DNA double-strand breaks. Nature. Jun. 8, 2000;405(6787):697-700. doi: 10.1038/35015097.
Safari et al., CRISPR Cpf1 proteins: structure, function and implications for genome editing. Cell Biosci. May 9, 2019;9:36. doi: 10.1186/s13578-019-0298-7.
San Filippo et al., Mechanism of eukaryotic homologous recombination. Annu Rev Biochem. 2008;77:229-57. doi: 10.1146/annurev.biochem.77.061306.125255.
Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.
Shen et al., Efficient genome modification by CRISPR-Cas9 nickase with minimal off-target effects. Nat Methods. Apr. 2014; 11(4):399-402. doi: 10.1038/nmeth.2857. Epub Mar. 2, 2014.
Song et al., RS-1 enhances CRISPR/Cas9- and TALEN-mediated knock-in efficiency. Nat Commun. Jan. 28, 2016;7:10548. doi: 10.1038/ncomms10548.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Trojan et al., Functional analysis of hMLH1 variants and HNPCC-related mutations using a human expression system. Gastroenterology. Jan. 2002;122(1):211-9. doi: 10.1053/gast.2002.30296.
Tsai et al., GUIDE-seq enables genome-wide profiling of off-target cleavage by CRISPR-Cas nucleases. Nat Biotechnol. Feb. 2015;33(2):187-197. doi: 10.1038/nbt.3117. Epub Dec. 16, 2014.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Den Oord et al., Pixel Recurrent Neural Networks. Proceedings of the 33rd International Conference on Machine Learning. Journal of Machine Learning Research. Aug. 19, 2016. vol. 48. 11 pages.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 2020.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.
Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yu et al., Dynamic control of Rad51 recombinase by self-association and interaction with BRCA2. Mol Cell. Oct. 2003;12(4):1029-41. doi: 10.1016/s1097-2765(03)00394-0.
Zhang et al., Efficient precise knockin with a double cut HDR donor after CRISPR/Cas9- mediated double-stranded DNA cleavage. Genome Biol. Feb. 20, 2017;18(1):35. doi: 10.1186/s13059-017-1164-8.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
International Preliminary Report on Patentability mailed Jun. 25, 2020 in connection with PCT/US2018/065886.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Reference Sequence: WP_087959824.1. Oct. 9, 2019. 2 pages.
[No Author Listed] Score result for SEQ 355 to W02017032580. Muir et al. 2016.

(56) References Cited

OTHER PUBLICATIONS

[No Author Listed], Gag-Pol polyprotein. UniProtKB/Swiss-Prot No. P03355.5. Sep. 18, 2019. 18 pages.
[No Author Listed], Homo sapiens signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.
Amrann et al., Tightly regulated tac promoter vectors useful for the expression of unfused and fused proteins in Escherichia coli. Gene. Sep. 30, 1988;69(2):301-15.
Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.
Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone. 0188593.
Beaudry et al., Directed evolution of an RNA enzyme. Science. Jul. 31, 1992;257(5070):635-41. doi: 10.1126/science.1496376.
Bertsimas et al., Simulated annealing. Statistical Science. Feb. 1993;8(1):10-15. doi: 10.1214/ss/1177011077.
Bibikova et al., Targeted chromosomal cleavage and mutagenesis in Drosophila using zinc-finger nucleases. Genetics. Jul. 2002;161(3):1169-75. doi: 10.1093/genetics/161.3.1169.
Blauw et al., SMN1 gene duplications are associated with sporadic ALS. Neurology. Mar. 13, 2012;78(11):776-80. doi: 10.1212/WNL. 0b013e318249f697. Epub Feb. 8, 2012.
Bogdanove et al., TAL effectors: customizable proteins for DNA targeting. Science. Sep. 30, 2011;333(6051):1843-6. doi: 10.1126/science.1204094.
Brutlag et al., Improved sensitivity of biological sequence database searches. Comput Appl Biosci. Jul. 1990;6(3):237-45. doi: 10.1093/bioinformatics/6.3.237.
Buckley et al., Targeting the von Hippel-Lindau E3 ubiquitin ligase using small molecules to disrupt the VHL/HIF-1 α interaction. J Am Chem Soc. Mar. 14, 2012;134(10):4465-8. doi: 10.1021/ja209924v. Epub Feb. 27, 2012.
Böck et al., Selenocysteine: the 21st amino acid. Mol Microbiol. Mar. 1991;5(3):515-20.
Canchaya et al., Genome analysis of an inducible prophage and prophage remnants integrated in the Streptococcus pyogenes strain SF370. Virology. Oct. 25, 2002;302(2):245-58. doi: 10.1006/viro. 2002.1570.
Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Chatterjee et al., A Cas9 with PAM recognition for adenine dinucleotides. Nat Commun. May 18, 2020;11(1):2474. doi: 10.1038/s41467-020-16117-8.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Chung-Il et al., Artificial control of gene expression in mammalian cells by modulating RNA interference through aptamer-small molecule interaction. RNA. May 2006;12(5):710-6. Epub Apr. 10, 2006.
Corcia et al., The importance of the SMN genes in the genetics of sporadic ALS. Amyotroph Lateral Scler. Oct. -Dec. 2009-Dec.;10(5-6):436-40. doi: 10.3109/17482960902759162.
Corti et al., Genetic correction of human induced pluripotent stem cells from patients with spinal muscular atrophy. Sci Transl Med. Dec. 19, 2012;4(165):165ra162. doi: 10.1126/scitranslmed. 3004108.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
D'Adda di Fagagna et al., The Gam protein of bacteriophage Mu is an orthologue of eukaryotic Ku. EMBO Rep. Jan. 2003;4(1):47-52.
D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
Dahlman et al., Orthogonal gene knockout and activation with a catalytically active Cas9 nuclease. Nat Biotechnol. Nov. 2015;33(11):1159-61. doi: 10.1038/nbt.3390.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc. M211644200. Epub Jan. 8, 2003.
De La Peña et al., The Hammerhead Ribozyme: A Long History for a Short RNA. Molecules. Jan. 4, 2017;22(1):78. doi: 10.3390/molecules22010078.
De Souza, Primer: genome editing with engineered nucleases. Nat Methods. Jan. 2012;9(1):27.
De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dickinson et al., A system for the continuous directed evolution of proteases rapidly reveals drug-resistance mutations. Nat Commun. Oct. 30, 2014;5:5352. doi: 10.1038/ncomms6352.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
East-Seletsky et al., Two distinct RNase activities of CRISPR-C2c2 enable guide-RNA processing and RNA detection. Nature Oct. 2016;538(7624):270-3.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.

(56) References Cited

OTHER PUBLICATIONS

Gao et al., DNA-guided genome editing using the Natronobacterium gregoryi Argonaute. Nat Biotechnol. Jul. 2016;34(7):768-73. doi: 10.1038/nbt.3547. Epub May 2, 2016.

Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.

Gaudelli et al., Directed evolution of adenine base editors with increased activity and therapeutic application. Nat Biotechnol. Jul. 2020;38(7):892-900. doi: 10.1038/s41587-020-0491-6. Epub Apr. 13, 2020.

Gaudelli et al., Programmable base editing of A•T to G•C in genomic DNA without DNA cleavage. Nature. Nov. 23, 2017;551(7681):464-471. doi: 10.1038/nature24644. Epub Oct. 25, 2017. Erratum in: Nature. May 2, 2018.

Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.

GENBANK Submission; NIH/NCBI, Accession No. NC_000001.11. Gregory et al., Jun. 6, 2016. 3 pages.

GENBANK Submission; NIH/NCBI, Accession No. NM_206933.2. Khalaileh et al., Sep. 16, 2018. 12 pages.

GENBANK Submission; NIH/NCBI, Accession No. NP_996816.2. Fu et al., Sep. 22, 2019. 9 pages.

Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.

Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.

Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.

Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.

Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.

Heyer et al., Regulation of homologous recombination in eukaryotes. Annu Rev Genet. 2010;44:113-39. doi: 10.1146/annurev-genet-051710-150955. Author Manuscript. 33 pages.

Hockemeyer et al., Genetic engineering of human pluripotent cells using TALE nucleases. Nat Biotechnol. Jul. 7, 2011;29(8):731-4. doi: 10.1038/nbt.1927.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houck-Loomis et al., An equilibrium-dependent retroviral mRNA switch regulates translational recoding. Nature. Nov. 27, 2011;480(7378):561-4. doi: 10.1038/nature10657.

Houseley et al., The many pathways of RNA degradation. Cell. Feb. 20, 2009;136(4):763-76. doi: 10.1016/j.cell.2009.01.019.

Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.

Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.

Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.

Jakimo et al., A Cas9 with Complete PAM Recognition for Adenine Dinucleotides. bioRxiv preprint. Sep. 27, 2018. doi.org/10.1101/429654. 29 pages.

Jeggo, DNA breakage and repair. Adv Genet. 1998;38:185-218. doi: 10.1016/s0065-2660(08)60144-3.

Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.

King et al., No gain, no pain: NaV1.7 as an analgesic target. ACS Chem Neurosci. Sep. 17, 2014;5(9):749-51. doi: 10.1021/cn500171p. Epub Aug. 11, 2014.

Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.

Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.

Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.

Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.

Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.

Langer et al., Chemical and Physical Structure of Polymers as Carriers for Controlled Release of Bioactive Agents: A Review. J Macromol Sci, Part C, 1983;23(1):61-126. doi: 10.1080/07366578308079439.

Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.

Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773.

Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773. 13 pages.

Lefebvre et al., Identification and characterization of a spinal muscular atrophy-determining gene. Cell. Jan. 13, 1995;80(1):155-65. doi: 10.1016/0092-8674(95)90460-3.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.

MacFadden et al., Mechanism and structural diversity of exoribonuclease-resistant RNA structures in flaviviral RNAs. Nat Commun. Jan. 9, 2018;9(1):119. doi: 10.1038/s41467-017-02604-y.

Maerker et al., A novel Usher protein network at the periciliary reloading point between molecular transport machineries in verte-

(56) References Cited

OTHER PUBLICATIONS brate photoreceptor cells. Hum Mol Genet. Jan. 1, 2008;17(1):71-86. doi: 10.1093/hmg/ddm285. Epub Sep. 28, 2007.

Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.

Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.

Mendell et al., Single-Dose Gene-Replacement Therapy for Spinal Muscular Atrophy. N Engl J Med. Nov. 2, 2017;377(18):1713-1722. doi: 10.1056/NEJMoa1706198.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.

Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.

Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

Ottesen, ISS-N1 makes the First FDA-approved Drug for Spinal Muscular Atrophy. Transl Neurosci. Jan. 26, 2017;8:1-6. doi: 10.1515/tnsci-2017-0001.

Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.

Parente et al., Advances in spinal muscular atrophy therapeutics. Ther Adv Neurol Disord. Feb. 5, 2018;11:1756285618754501. doi: 10.1177/1756285618754501. 13 pages.

Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.

Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.

Pendse et al., In Vivo Assessment of Potential Therapeutic Approaches for USH2A-Associated Diseases. Adv Exp Med Biol. 2019;1185:91-96. doi: 10.1007/978-3-030-27378-1_15.

Pfeiffer et al., Mechanisms of DNA double-strand break repair and their potential to induce chromosomal aberrations. Mutagenesis. Jul. 2000;15(4):289-302. doi: 10.1093/mutage/15.4.289.

Pieken et al., Kinetic characterization of ribonuclease-resistant 2'-modified hammerhead ribozymes. Science. Jul. 19, 1991;253(5017):314-7. doi: 10.1126/science.1857967.

Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.

Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.

Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.

Prashant et al., CAS9 transcriptional activators for target specificity screening and paired nickases for cooperative genome engineering. Nature Biotechnology 2013;31(9):833-8.

Ramos et al., Age-dependent SMN expression in disease-relevant tissue and implications for SMA treatment. J Clin Invest. Nov. 1, 2019;129(11):4817-4831. doi: 10.1172/JCI124120.

Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.

Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.

Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.

Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.

Sadowski, The Flp recombinase of the 2-microns plasmid of *Saccharomyces cerevisiae*. Prog Nucleic Acid Res Mol Biol. 1995;51:53-91.

Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.

Schechner et al., Multiplexable, locus-specific targeting of long RNAs with CRISPR-Display. Nat Methods. Jul. 2015;12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.

Schrank et al., Inactivation of the survival motor neuron gene, a candidate gene for human spinal muscular atrophy, leads to massive cell death in early mouse embryos. Proc Natl Acad Sci USA. Sep. 2, 1997;94(18):9920-5. doi: 10.1073/pnas.94.18.9920.

Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.

Score Results for Shimomura et al., Complete Genome Sequencing and Analysis of a Lancefield Group G Rt *Streptococcus dysagalactiae* Subsp. *equisimilis* Strain Causing Streptococcal RT Toxic Shock Syndrome (Stss). RL BMC Genomics. 2011;12:17-17. 3 pages.

Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.

Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.

Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.

Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.

Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.

Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.

Talbot et al., Spinal muscular atrophy. Semin Neurol. Jun. 2001;21(2):189-97. doi: 10.1055/s-2001-15264.

(56) References Cited

OTHER PUBLICATIONS

Uniprot Consortium, UniProt: the universal protein knowledgebase. Nucleic Acids Res. Mar. 16, 2018;46(5):2699. doi: 10.1093/nar/gky092. Erratum for: Nucleic Acids Res. Jan. 4, 2017;45(D1):D158-D169.

Van Brunt et al., Molecular Farming: Transgenic Animals as Bioreactors. Biotechnology (NY). 1988;6(10):1149-1154. doi: 10.1038/nbt1088-1149.

Van Duyne et al., Teaching Cre to follow directions. Proc Natl Acad Sci U S A. Jan. 6, 2009;106(1):4-5. doi: 10.1073/pnas.0811624106. Epub Dec. 31, 2008.

Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.

Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.

Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.

Vidal et al., Yeast forward and reverse 'n'-hybrid systems. Nucleic Acids Res. Feb. 15, 1999;27(4):919-29. doi: 10.1093/nar/27.4.919.

Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.

Walton et al., Unconstrained genome targeting with near-PAMless engineered CRISPR-Cas9 variants. Science. Apr. 17, 2020;368(6488):290-296. doi: 10.1126/science.aba8853. Epub Mar. 26, 2020.

Wirth et al., Mildly affected patients with spinal muscular atrophy are partially protected by an increased SMN2 copy number Hum Genet. May 2006;119(4):422-8. doi: 10.1007/s00439-006-0156-7. Epub Mar. 1, 2006.

Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.

Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.

Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.

Wu et al., Widespread Influence of 3'-End Structures on Mammalian mRNA Processing and Stability. Cell. May 18, 2017;169(5):905-917.e11. doi: 10.1016/j.cell.2017.04.036.

Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.

Yu et al., Cytosine base editors with minimized unguided DNA and RNA off-target events and high on-target activity. Nat Commun. Apr. 28, 2020;11(1):2052. doi: 10.1038/s41467-020-15887-5.

Zhang et al., Large genomic fragment deletions and insertions in mouse using CRISPR/Cas9. PLoS One. Mar. 24, 2015;10(3):e0120396. doi: 10.1371/journal.pone.0120396. 14 pages.

[No Author Listed], MutL homolog 1. UniProtKB Acc. No. F1MPG0. May 3, 2011. Accessible at https://rest.uniprot.org/unisave/F1MPG0?format=txt&versions=1. 1 page.

Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.

Edraki et al., A Compact, High-Accuracy Cas9 with a Dinucleotide PAM for In Vivo Genome Editing. Mol Cell. Feb. 21, 2019;73(4):714-726.e4 and Supplemental Info. doi: 10.1016/j.molcel.2018.12.003. Epub Dec. 20, 2018.

Fang et al., Human strand-specific mismatch repair occurs by a bidirectional mechanism similar to that of the bacterial reaction. J Biol Chem. Jun. 5, 1993;268(16):11838-44.

Feng et al., Efficient genome editing in plants using a CRISPR/Cas system. Cell Res. Oct. 2013;23(10):1229-32. doi: 10.1038/cr.2013.114. Epub Aug. 20, 2013.

Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.

Geng et al., In vitro studies of DNA mismatch repair proteins. Anal Biochem. Jun. 15, 2011;413(2):179-84. doi: 10.1016/j.ab.2011.02.017. Epub Feb. 15, 2011.

Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.

Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.

Gueneau et al., Structure of the MutLα C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.

Guerrette et al., The interaction of the human MutL homologues in hereditary nonpolyposis colon cancer. J Biol Chem. Mar. 5, 1999;274(10):6336-41. doi: 10.1074/jbc.274.10.6336.

Gupta et al., Mechanism of mismatch recognition revealed by human MutSβ bound to unpaired DNA loops. Nat Struct Mol Biol. Dec. 18, 2011;19(1):72-8. doi: 10.1038/nsmb.2175.

Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9.2677.

Iyer et al., DNA mismatch repair: functions and mechanisms. Chem Rev. Feb. 2006;106(2):302-23. doi: 10.1021/cr0404794.

Kadyrov et al., Endonucleolytic function of MutLalpha in human mismatch repair. Cell. Jul. 28, 2006;126(2):297-308. doi: 10.1016/j.cell.2006.05.039.

Kunkel et al., DNA mismatch repair. Annu Rev Biochem. 2005;74:681-710. doi: 10.1146/annurev.biochem.74.082803.133243.

Lahue et al., DNA mismatch correction in a defined system. Science. Jul. 14, 1989;245(4914):160-4. doi: 10.1126/science.2665076.

Leach et al., Mutations of a mutS homolog in hereditary nonpolyposis colorectal cancer. Cell. Dec. 17, 1993;75(6):1215-25. doi: 10.1016/0092-8674(93)90330-s.

Longsworth, Expanding the Enzymatic Activity of the Programmable Endonuclease Cas9 in Zebrafish. Thesis. Rice University. Houston, TX. May 17, 2019. 41 pages.

Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.

Lyu et al., Virus-Like Particle Mediated CRISPR/Cas9 Delivery for Efficient and Safe Genome Editing. Life (Basel). Dec. 21, 2020;10(12):366. doi: 10.3390/life10120366.

Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Parsons et al., Hypermutability and mismatch repair deficiency in RER+ tumor cells. Cell. Dec. 17, 1993;75(6):1227-36. doi: 10.1016/0092-8674(93)90331-j.

(56) References Cited

OTHER PUBLICATIONS

Petit et al., Powerful mutators lurking in the genome. Philos Trans R Soc Lond B Biol Sci. Mar. 12, 2009;364(1517):705-15. doi: 10.1098/rstb.2008.0272.

Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.

Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.

Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.

Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.

Su et al., Mispair specificity of methyl-directed DNA mismatch correction in vitro. J Biol Chem. May 15, 1988;263(14):6829-35. Erratum in: J Biol Chem Aug. 5, 1988;263(22):11015.

Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.

Supek et al., Differential DNA mismatch repair underlies mutation rate variation across the human genome. Nature. May 7, 2015;521(7550):81-4. doi: 10.1038/nature14173. Epub Feb. 23, 2015.

Thomas et al., Heteroduplex repair in extracts of human HeLa cells. J Biol Chem. Feb. 25, 1991;266(6):3744-51.

Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.

Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.

Umar et al., DNA loop repair by human cell extracts. Science. Nov. 4, 1994;266(5186):814-6. doi: 10.1126/science.7973637.

Warren et al., Structure of the human MutSalpha DNA lesion recognition complex. Mol Cell. May 25, 2007;26(4):579-92. doi: 10.1016/j.molcel.2007.04.018.

Xi et al., C-terminal Loop Mutations Determine Folding and Secretion Properties of PCSK9. Biochem Mol Biol J. 2016;2(3):17. doi: 10.21767/2471-8084.100026. 12 pages.

Zhang et al., Reconstitution of 5'-directed human mismatch repair in a purified system. Cell. Sep. 9, 2005;122(5):693-705. doi: 10.1016/j.cell.2005.06.027.

[No Author Listed] NCBI Reference Sequence: WP_032188360.1. Apr. 6, 2015. 1 page.

[No Author Listed], tRNA-specific adenosine deaminase [*Escherichia coli*]. GenBank Acc. No. CTS26096.1. Accessible at https://www.ncbi.nlm.nih.gov/protein/CTS26096.1. Aug. 22, 2015. 1 page.

Alizadeh et al., HR9: An Important Cell Penetrating Peptide for Delivery of HCV NS3 DNA into HEK-293T Cells. Avicenna J Med Biotechnol. Jan.-Mar. 2020(1):44-51.

Avidan et al., Expression and characterization of a recombinant novel reverse transcriptase of a porcine endogenous retrovirus. Virology. Mar. 15, 2003;307(2):341-57. doi: 10.1016/s0042-6822(02)00131-9.

Bae et al., Heteroclitic CD33 peptide with enhanced anti-acute myeloid leukemic immunogenicity. Clin Cancer Res. Oct. 15, 2004;10(20):7043-52. doi: 10.1158/1078-0432.CCR-04-0322.

Baños-Sanz et al., Crystal structure and functional insights into uracil-DNA glycosylase inhibition by phage Φ29 DNA mimic protein p56. Nucleic Acids Res. Jul. 2013;41(13):6761-73. doi: 10.1093/nar/gkt395. Epub May 13, 2013.

Cheriyan et al., Faster protein splicing with the Nostoc punctiforme DnaE intein using non-native extein residues. J Biol Chem. Mar. 1, 2013;288(9):6202-11. doi: 10.1074/jbc.M112.433094. Epub Jan. 10, 2013.

Choi et al., Optimization of AAV expression cassettes to improve packaging capacity and transgene expression in neurons. Mol Brain. Mar. 1, 20141;7:17. doi: 10.1186/1756-6606-7-17.

Damdindorj et al., A comparative analysis of constitutive promoters located in adeno-associated viral vectors. PLoS One. Aug. 29, 2014;9(8):e106472. doi: 10.1371/journal.pone.0106472.

Ding et al., Gene therapy for cardiovascular disease. Journal of Shanghai University (Natural Science Edition) . 2016;3:270-9 . DOI: 10.3969/j.issn.1007-2861.2016.03.013.

Ekman et al., CRISPR/Cas9-Mediated Genome Editing Increases Lifespan and Improves Motor Deficits in a Huntington's Disease Mouse Model. Mol Ther Nucleic Acids. Sep. 6, 2019;17:829-839. doi: 10.1016/j.omtn.2019.07.009. Epub Jul. 26, 2019.

Eriksen et al., Occlusion of the Ribosome Binding Site Connects the Translational Initiation Frequency, mRNA Stability and Premature Transcription Termination. Front Microbiol. Mar. 14, 2017;8:362. doi: 10.3389/fmicb.2017.00362.

Fikes et al., Design of multi-epitope, analogue-based cancer vaccines. Expert Opin Biol Ther. Sep. 2003;3(6):985-93. doi: 10.1517/14712598.3.6.985.

GenBank Submission; NIH/NCBI, Accession No. NP_060228.2. Bi et al., Dec. 21, 2005. 1 page.

GenBank Submission; NIH/NCBI, Accession No. NP_062826.2. Bokar et al., Sep. 18, 2004. 2 pages.

GenBank Submission; NIH/NCBI, Accession No. NP_066012.1. Ota et al., Apr. 3, 2005. 2 pages.

GenBank Submission; NIH/NCBI, Accession No. WP_042518169.1. No Author, Feb. 10, 2015. 1 page.

Hizi et al., Retroviral reverse transcriptases (other than those of HIV-1 and murine leukemia virus): a comparison of their molecular and biochemical properties. Virus Res. Jun. 2008;134(1-2):203-20. doi: 10.1016/j.virusres.2007.12.008. Epub Mar. 3, 2008.

Houghton et al., Immunological validation of the EpitOptimizer program for streamlined design of heteroclitic epitopes. Vaccine. Jul. 20, 2007;25(29):5330-42. doi: 10.1016/j.vaccine.2007.05.008. Epub Jun. 4, 2007.

Hwang et al., Heritable and precise zebrafish genome editing using a CRISPR-Cas system. PLoS One. Jul. 9, 2013;8(7):e68708. doi: 10.1371/journal.pone.0068708.

Karimian et al., CRISPR/Cas9 novel therapeutic road for the treatment of neurodegenerative diseases. Life Sci. Oct. 15, 2020;259:118165. doi: 10.1016/j.lfs.2020.118165. Epub Jul. 29, 2020.

Kirshenboim et al., Expression and characterization of a novel reverse transcriptase of the LTR retrotransposon Tf1. Virology. Sep. 30, 2007;366(2):263-76. doi: 10.1016/j.virol.2007.04.002. Epub May 23, 2007.

Mariani et al., Species-specific exclusion of APOBEC3G from HIV-1 virions by Vif. Cell. Jul. 11, 2003;114(1):21-31. doi: 10.1016/s0092-8674(03)00515-4.

Misra et al., An enzymatically active chimeric HIV-1 reverse transcriptase (RT) with the RNase-H domain of murine leukemia virus RT exists as a monomer. J Biol Chem. Apr. 17, 1998;273(16):9785-9. doi: 10.1074/jbc.273.16.9785.

Nguyen Tran et al., Engineering domain-inlaid SaCas9 adenine base editors with reduced RNA off-targets and increased on-target DNA editing. Nat Commun. Sep. 25, 2020;11(1):4871. doi: 10.1038/s41467-020-18715-y.

Niemeyer, C.M., Semisynthetic DNA-protein conjugates for biosensing and nanofabrication. Angew Chem Int Ed Engl. Feb. 8, 2010;49(7):1200-16. doi: 10.1002/anie.200904930.

Nowak et al., Ty3 reverse transcriptase complexed with an RNA-DNA hybrid shows structural and functional asymmetry. Nat Struct Mol Biol. Apr. 2014;21(4):389-96. doi: 10.1038/nsmb.2785. Epub Mar. 9, 2014. Author Manuscript, 22 pages.

Raaijmakers et al., CRISPR/Cas Applications in Myotonic Dystrophy: Expanding Opportunities. Int J Mol Sci. Jul. 27, 2019;20(15):3689. doi: 10.3390/ijms20153689.

(56) References Cited

OTHER PUBLICATIONS

Riddle et al., Frameshift suppression: a nucleotide addition in the anticodon of a glycine transfer RNA. Nat New Biol. Apr. 25, 1973;242(121):230-4. doi: 10.1038/newbio242230a0.
Riddle et al., Frameshift suppressors. II. Genetic mapping and dominance studies. J Mol Biol. May 28, 1972;66(3):483-93. doi: 10.1016/0022-2836(72)90428-7.
Riddle et al., Suppressors of frameshift mutations in *Salmonella typhimurium*. J Mol Biol. Nov. 28, 1970;54(1):131-44. doi: 10.1016/0022-2836(70)90451-1.
Sadowski et al., The sequence-structure relationship and protein function prediction. Curr Opin Struct Biol. Jun. 2009;19(3):357-62. doi: 10.1016/j.sbi.2009.03.008. Epub May 4, 2009.
Score Results for US 2014-0186919 A1 to Zhang et al. Aug. 2, 20148. 3 pages.
Seffernick et al., Melamine deaminase and atrazine chlorohydrolase: 98 percent identical but functionally different. J Bacteriol. Apr. 2001; 183(8):2405-10. doi: 10.1128/JB.183.8.2405-2410.2001.
Shalaby et al., Tissue-Specific Delivery of CRISPR Therapeutics: Strategies and Mechanisms of Non-Viral Vectors. Int J Mol Sci. Oct. 5, 2020;21(19):7353. doi: 10.3390/ijms21197353.
Simon et al., Retrons and their applications in genome engineering. Nucleic Acids Res. Dec. 2, 2019;47(21):11007-11019. doi: 10.1093/nar/gkz865.
Singh et al., Protein Engineering Approaches in the Post-Genomic Era. Curr Protein Pept Sci. 2018;19(1):5-15. doi: 10.2174/1389203718666161117114243.
Studebaker et al., Depletion of uracil-DNA glycosylase activity is associated with decreased cell proliferation. Biochem Biophys Res Commun. Aug. 26, 2005;334(2):509-15. doi: 10.1016/j.bbrc.2005.06.118.
Suh et al., Publisher Correction: Restoration of visual function in adult mice with an inherited retinal disease via adenine base editing. Nat Biomed Eng. Nov. 2020;4(11):1119. doi: 10.1038/s41551-020-00652-2. Erratum for: Nat Biomed Eng. Oct. 19, 2020.
Tang et al., Identification of Dehalobacter reductive dehalogenases that catalyse dechlorination of chloroform, 1,1,1-trichloroethane and 1,1-dichloroethane. Philos Trans R Soc Lond B Biol Sci. Mar. 11, 2013;368(1616):20120318. doi: 10.1098/rstb.2012.0318.
Toro et al., Comprehensive phylogenetic analysis of bacterial reverse transcriptases. PLoS One. Nov. 25, 2014;9(11):e114083. doi: 10.1371/journal.pone.0114083.
Witkowski et al., Conversion of a beta-ketoacyl synthase to a malonyl decarboxylase by replacement of the active-site cysteine with glutamine. Biochemistry. Sep. 7, 1999;38(36):11643-50. doi: 10.1021/bi990993h.
Yin et al., Optimizing genome editing strategy by primer-extension-mediated sequencing. Cell Discov. Mar. 26, 2019;5:18. doi: 10.1038/s41421-019-0088-8.
Zhang et al., Propagated Perturbations from a Peripheral Mutation Show Interactions Supporting WW Domain Thermostability. Structure. Nov. 6, 2018;26(11):1474-1485.e5. doi: 10.1016/j.str.2018.07.014. Epub Sep. 6, 2018.
[No Author Listed], CMP/dCMP-type deaminase domain-containing protein. Uniprot Accession No. A0A2Z6RZE9. Oct. 10, 2018. Accessible at https://www.uniprot.org/uniprotkb/A0A2Z6RZE9/entry. 8 pages.
[No Author Listed], dCas9-5xPlat2AfID-P2A-scFvGCN4sfGFPTET1CD [Cloning vector pPlatTET-gRNA2]. GenBank No. BAV54124. Apr. 18, 2017. 5 pages.
[No. Author Listed], tRNA-specific adenosine deaminase [Candidatus Moranella endobia PCVAL]. GenBank Acc. No. AGJ61179.1. Accessible at https://www.ncbi.nlm.nih.gov/protein/AGJ61179. Jan. 30, 2014. 3 pages.
[No Author Listed], tRNA-specific adenosine deaminase 2 [Terrapene triunguis]. GenBank Acc. No. XP_024075810.1. Accessible at https://www.ncbi.nlm.nih.gov/protein/XP_024075810. Jul. 15, 2019. 2 pages.
[No Author Listed], tRNA-specific adenosine deaminase TAD2 isoform X1 [*Oryza sativa japonica* Group]. GenBank Acc. No. XP_15631651.1. Accessible at https://www.ncbi.nlm.nih.gov/protein/1002254769?sat=58&satkey=133677684. Aug. 7, 2018. 2 pages.
[No Author Listed], tRNA-specific adenosine deaminase TAD2 isoform X2 [*Panicum hallii*]. GenBank Acc. No. XP_025793740.1. Accessible at https://www.ncbi.nlm.nih.gov/protein/025793740. Jul. 27, 2018. 1 page.
[No Author Listed], tRNA-specific adenosine deaminase. Uniprot Accession No. A0A1U7M801. May 10, 2017. Accessible at https://www.uniprot.org/uniprotkb/A0A1U7M801/history. 3 pages.
[No Author Listed], tRNA-specific adenosine deaminase. Uniprot Accession No. A0A1Z4VPW4. Sep. 27, 2017 Accessible at https://www.uniprot.org/uniprotkb/A0A1Z4VPW4/history. 3 pages.
[No Author Listed], tRNA-specific adenosine deaminase. Uniprot Accession No. A0A1Z9LY19. Oct. 25, 2017. Accessible at https://www.uniprot.org/uniprotkb/A0A1Z9LY19/entry. 12 pages.
[No Author Listed], tRNA-specific adenosine deaminase. Uniprot Accession No. A0A2P5TOZ9. May 23, 20183. Accessible at https://www.uniprot.org/uniprotkb/A0A2P5T0Z9/entry. 10 pages.
[No Author Listed], tRNA-specific adenosine deaminase. Uniprot Accession No. A0A4P6PH16. Jul. 31, 2019. Accessible at https://www.uniprot.org/uniprotkb/A0A4P6PH16/entry. 12 pages.
[No Author Listed], tRNA-specific adenosine deaminase. Uniprot Accession No. A0A520SVM3. Oct. 16, 2019. Accessible at https://www.uniprot.org/uniprotkb/A0A520SVM3/entry. 10 pages.
[No Author Listed], tRNA-specific adenosine deaminase. Uniprot Accession No. U2JUU0. Nov. 13, 2013. Accessible at https://www.uniprot.org/uniprotkb/U2JUU0/entry. 11 pages.
Alves et al., Immunogenicity of the carcinoembryonic antigen derived peptide 694 in HLA-A2 healthy donors and colorectal carcinoma patients. Cancer Immunol Immunother. Nov. 2007;56(11):1795-805. doi: 10.1007/s00262-007-0323-2. Epub Apr. 20, 2007.
Asemissen et al., Identification of a highly immunogenic HLA-A*01-binding T cell epitope of WT1. Clin Cancer Res. Dec. 15, 2006;12(24):7476-82. doi: 10.1158/1078-0432.CCR-06-1337.
Attia et al., Autoimmunity correlates with tumor regression in patients with metastatic melanoma treated with anti-cytotoxic T-lymphocyte antigen-4. J Clin Oncol. Sep. 1, 2005;23(25):6043-53. doi: 10.1200/JCO.2005.06.205. Epub Aug. 8, 2005.
Aurisicchio et al., A novel minigene scaffold for therapeutic cancer vaccines. Oncoimmunology. Jan. 1, 2014;3(1):e27529. doi: 10.4161/onci.27529. Epub Jan. 16, 2014.
Bae et al., Identification of novel CD33 antigen-specific peptides for the generation of cytotoxic T lymphocytes against acute myeloid leukemia. Cell Immunol. Jan. 2004;227(1):38-50. doi: 10.1016/j.cellimm.2004.01.002.
Bakker et al., Analogues of CTL epitopes with improved MHC class-I binding capacity elicit anti-melanoma CTL recognizing the wild-type epitope. Int J Cancer. Jan. 27, 1997;70(3):302-9. doi: 10.1002/(sici)1097-0215(19970127)70:3<302::aid-ijc10>3.0.co;2-h.
Banerjee et al., Viral glycoproteins: biological role and application in diagnosis. Virusdisease. Mar. 2016;27(1):1-11. doi: 10.1007/s13337-015-0293-5. Epub Jan. 18, 2016.
Barve et al., Induction of immune responses and clinical efficacy in a phase II trial of IDM-2101, a 10-epitope cytotoxic T-lymphocyte vaccine, in metastatic non-small-cell lung cancer. J Clin Oncol. Sep. 20, 2008;26(27):4418-25. doi: 10.1200/JCO.2008.16.6462.
Benlalam et al., Identification of five new HLA-B*3501-restricted epitopes derived from common melanoma-associated antigens, spontaneously recognized by tumor-infiltrating lymphocytes. J Immunol. Dec. 1, 2003;171(11):6283-9. doi: 10.4049/jimmunol.171.11.6283.
Bernatchez et al., Altered decamer and nonamer from an HLA-A0201-restricted epitope of Survivin differentially stimulate T-cell responses in different individuals. Vaccine. Apr. 5, 2011;29(16):3021-30. doi: 10.1016/j.vaccine.2011.01.115. Epub Feb. 12, 2011.
Bioley et al., Melan-A/MART-1-specific CD4 T cells in melanoma patients: identification of new epitopes and ex vivo visualization of specific T cells by MHC class II tetramers. J Immunol. Nov. 15, 2006;177(10):6769-79. doi: 10.4049/jimmunol.177.10.6769.
Blanchet et al., A new generation of Melan-A/MART-1 peptides that fulfill both increased immunogenicity and high resistance to bio-

(56) References Cited

OTHER PUBLICATIONS degradation: implication for molecular anti-melanoma immunotherapy. J Immunol. Nov. 15, 2001;167(10):5852-61. doi: 10.4049/jimmunol.167.10.5852.

Bolukbasi et al., DNA-binding-domain fusions enhance the targeting range and precision of Cas9. Nat Methods. Dec. 2015;12(12):1150-6. doi: 10.1038/nmeth.3624. Epub Oct. 19, 2015.

Borbulevych et al., Increased immunogenicity of an anchor-modified tumor-associated antigen is due to the enhanced stability of the peptide/MHC complex: implications for vaccine design. J Immunol. Apr. 15, 2005;174(8):4812-20. doi: 10.4049/jimmunol.174.8.4812.

Brichard et al., A tyrosinase nonapeptide presented by HLA-B44 is recognized on a human melanoma by autologous cytolytic T lymphocytes. Eur J Immunol. Jan. 1996;26(1):224-30. doi: 10.1002/eji.1830260135.

Cacabelos et al., Chapter 1—The Epigenetic Machinery in the Life Cycle and Pharmacoepigenetics. Pharmacoepigenetics. vol. 10 in Translational Epigenetics. 2019:1-100. doi: https://doi.org/10.1016/B978-0-12-813939-4.00001-2. 7 pages.

Campbell et al., Gesicle-Mediated Delivery of CRISPR/Cas9 Ribonucleoprotein Complex for Inactivating the HIV Provirus. Mol Ther. Jan. 2, 2019;27(1):151-163. doi: 10.1016/j.ymthe.2018.10.002. Epub Oct. 11, 2018.

Campi et al., CD4(+) T cells from healthy subjects and colon cancer patients recognize a carcinoembryonic antigen-specific immunodominant epitope. Cancer Res. Dec. 1, 2003;63(23):8481-6.

Casnici et al., Immunologic evaluation of peptides derived from BCR/ABL-out-of-frame fusion protein in Hla A2.1 transgenic mice. J Immunother. May 2012;35(4):321-8. doi: 10.1097/CJI.0b013e3182562d37.

Casnici et al., Out of frame peptides from BCR/ABL alternative splicing are immunogenic in HLA A2.1 transgenic mice. Cancer Lett. Apr. 8, 2009;276(1):61-7. doi: 10.1016/j.canlet.2008.10.032. Epub Dec. 4, 2008.

Castelli et al., Mass spectrometric identification of a naturally processed melanoma peptide recognized by CD8+ cytotoxic T lymphocytes. J Exp Med. Jan. 1, 1995;181(1):363-8. doi: 10.1084/jem.181.1.363.

Castelli et al., Novel HLA-Cw8-restricted T cell epitopes derived from tyrosinase-related protein-2 and gp100 melanoma antigens. J Immunol. Feb. 1, 1999;162(3):1739-48.

Castle et al., Exploiting the mutanome for tumor vaccination. Cancer Res. Mar. 1, 2012;72(5): 1081-91. doi: 10.1158/0008-5472.CAN-11-3722. Epub Jan. 11, 2012.

Cervera et al., Generation of HIV-1 Gag VLPs by transient transfection of HEK 293 suspension cell cultures using an optimized animal-derived component free medium. J Biotechnol. Jul. 20, 2013;166(4):152-65. doi: 10.1016/j.jbiotec.2013.05.001. Epub May 17, 2013.

Chen et al., Identification of NY-ESO-1 peptide analogues capable of improved stimulation of tumor-reactive Ctl. J Immunol. Jul. 15, 2000;165(2):948-55. doi: 10.4049/jimmunol.165.2.948.

Cho et al., Optimized peptide vaccines eliciting extensive CD8 T-cell responses with therapeutic antitumor effects. Cancer Res. Dec. 1, 2009;69(23):9012-9. doi: 10.1158/0008-5472.CAN-9-2019. Epub Nov. 10, 2009.

Choi et al., Lentivirus pre-packed with Cas9 protein for safer gene editing. Gene Ther. Jul. 2016;23(7):627-33. doi: 10.1038/gt.2016.27. Epub Apr. 7, 2016.

Christensen et al., Melan-A/MART1 analog peptide triggers antimyeloma T-cells through crossreactivity with HM1.24. J Immunother. Jul.-Aug. 2009;32(6):613-21. doi: 10.1097/CJI.0b013e3181a95198.

Coey, Sumoylation of thymine DNA glycosylase occurs efficiently and weakens DNA binding but does not regulate enzymatic turnover. Dissertation. 2017. 178 pages.

Correale et al., In vitro generation of human cytotoxic T lymphocytes specific for peptides derived from prostate-specific antigen. J Natl Cancer Inst. Feb. 19, 1997;89(4):293-300. doi: 10.1093/jnci/89.4.293.

Cox et al., Identification of a peptide recognized by five melanoma-specific human cytotoxic T cell lines. Science. Apr. 29, 1994;264(5159):716-9. doi: 10.1126/science.7513441.

Cronin et al., Altering the tropism of lentiviral vectors through pseudotyping. Curr Gene Ther. Aug. 2005;5(4):387-98. doi: 10.2174/1566523054546224. Erratum in: Curr Gene Ther. Oct. 2005;5(5):531. Author Manuscript, 19 pages.

Crosti et al., Identification of novel subdominant epitopes on the carcinoembryonic antigen recognized by CD4+ T cells of lung cancer patients. J Immunol. Apr. 15, 2006;176(8):5093-9. doi: 10.4049/jimmunol.176.8.5093.

Dalet et al., An antigenic peptide produced by reverse splicing and double asparagine deamidation. Proc Natl Acad Sci U S A. Jul. 11, 2011;108(29):E323-31. doi: 10.1073/pnas.1101892108. Epub Jun. 13, 2011.

David et al., Viral Vectors: The Road to Reducing Genotoxicity. Toxicol Sci. Feb. 2017;155(2):315-325. doi: 10.1093/toxsci/kfw220. Epub Nov. 1, 2016.

Depontieu et al., Identification of tumor-associated, MHC class II-restricted phosphopeptides as targets for immunotherapy. Proc Natl Acad Sci U S A. Jul. 21, 2009;106(29):12073-8. doi: 10.1073/pnas.0903852106. Epub Jul. 6, 2009.

Di Stasi et al., Review of the Results of WT1 Peptide Vaccination Strategies for Myelodysplastic Syndromes and Acute Myeloid Leukemia from Nine Different Studies. Front Immunol. Feb. 4, 2015;6:36. doi: 10.3389/fimmu.2015.00036.

Duan et al., Immune rejection of mouse tumors expressing mutated self. Cancer Res. Apr. 15, 2009;69(8):3545-53. doi: 10.1158/0008-5472.CAN-08-2779. Epub Apr. 7, 2009. Author Manuscript. 18 pages.

Duportet et al., A platform for rapid prototyping of synthetic gene networks in mammalian cells. Nucleic Acids Res. Dec. 1, 2014;42(21):13440-51. doi: 10.1093/nar/gku1082. Epub Nov. 5, 2014.

Fontana et al., Rabies virus-like particles expressed in HEK293 cells. Vaccine. May 19, 2014;32(24):2799-804. doi: 10.1016/j.vaccine.2014.02.031. Epub Mar. 12, 2014.

Fonteneau et al., The Tumor Antigen NY-ESO-1 Mediates Direct Recognition of Melanoma Cells by CD4+ T Cells after Intercellular Antigen Transfer. J Immunol. Jan. 1, 2016;196(1):64-71. doi: 10.4049/jimmunol.1402664. Epub Nov. 25, 2015.

Fourcade et al., PD-1 and Tim-3 regulate the expansion of tumor antigen-specific CD8+ T cells induced by melanoma vaccines. Cancer Res. Feb. 15, 2014;74(4):1045-55. doi: 10.1158/0008-5472.CAN-13-2908. Epub Dec. 16, 2013.

Fridman et al., An efficient T-cell epitope discovery strategy using in silico prediction and the iTopia assay platform. Oncoimmunology. Nov. 1, 2012;1(8):1258-1270. doi: 10.4161/onci.21355.

Fujiki et al., Identification and characterization of a WT1 (Wilms Tumor Gene) protein-derived HLA-DRB1*0405-restricted 16-mer helper peptide that promotes the induction and activation of WT1-specific cytotoxic T lymphocytes. J Immunother. Apr. 2007;30(3):282-93. doi: 10.1097/01.cji.0000211337.91513.94.

Gee et al., Extracellular nanovesicles for packaging of CRISPR-Cas9 protein and sgRNA to induce therapeutic exon skipping. Nat Commun. Mar. 13, 2020;11(1):1334. doi: 10.1038/s41467-020-14957-y.

GenBank Access No. BAP64357. Aug. 1, 2013 1 page.

Geynisman et al., A randomized pilot phase I study of modified carcinoembryonic antigen (CEA) peptide (CAP1-6D)/montanide/GM-CSF-vaccine in patients with pancreatic adenocarcinoma. J Immunother Cancer. Jun. 27, 2013;1:8. doi: 10.1186/2051-1426-1-8.

Ghosh et al., Synapsis in phage Bxb1 integration: selection mechanism for the correct pair of recombination sites. J Mol Biol. Jun. 3, 2005;349(2):331-48. doi: 10.1016/j.jmb.2005.03.043. Epub Apr. 7, 2005.

Girard-Gagnepain et al., Baboon envelope pseudotyped LVs outperform VSV-G-LVs for gene transfer into early-cytokine-stimulated and resting HSCs. Blood. Aug. 21, 2014;124(8):1221-31. doi: 10.1182/blood-2014-02-558163. Epub Jun. 20, 2014.

(56) References Cited

OTHER PUBLICATIONS

Godefroy et al., Identification of two Melan-A CD4+ T cell epitopes presented by frequently expressed MHC class II alleles. Clin Immunol. Oct. 2006; 121(1):54-62. doi: 10.1016/j.clim.2006.05.007. Epub Jun. 30, 2006.

Graff-Dubois et al., Generation of CTL recognizing an HLA-A*0201-restricted epitope shared by MAGE-A1, -A2, -A3, -A4, -A6, -A10, and -A12 tumor antigens: implication in a broad-spectrum tumor immunotherapy. J Immunol. Jul. 1, 2002;169(1):575-80. doi: 10.4049/jimmunol.169.1.575.

Gross et al., High vaccination efficiency of low-affinity epitopes in antitumor immunotherapy. J Clin Invest. Feb. 2004;113(3):425-33. doi: 10.1172/JCI19418.

Guevara-Patiño et al., Optimization of a self antigen for presentation of multiple epitopes in cancer immunity. J Clin Invest. May 2006;116(5):1382-90. doi: 10.1172/JCI25591. Epub Apr. 13, 2006.

Guibinga et al., Cell surface heparan sulfate is a receptor for attachment of envelope protein-free retrovirus-like particles and VSV-G pseudotyped MLV-derived retrovirus vectors to target cells. Mol Ther. May 2002;5(5 Pt 1):538-46. doi: 10.1006/mthe.2002.0578.

Gulley et al., Combining a Recombinant Cancer Vaccine with Standard Definitive Radiotherapy in Patients with Localized Prostate Cancer. Clin Cancer Res. May 2, 2005;11(9):3353-62. doi: 10.1158/1078-0432.CCR-04-2062.

Guo et al., Direct recognition and lysis of leukemia cells by WT1-specific CD4+ T lymphocytes in an HLA class II-restricted manner. Blood. Aug. 15, 2005;106(4): 1415-8. doi: 10.1182/blood-2005-01-0413. Epub Apr. 21, 2005.

Haeussler et al., Genome Editing with CRISPR-Cas9: Can It Get Any Better? J Genet Genomics. May 20, 2016;43(5):239-50. doi: 10.1016/j.jgg.2016.04.008. Epub Apr. 24, 2016. Author Manuscript. 22 pages.

Herbst-Kralovetz et al., Norwalk virus-like particles as vaccines. Expert Rev Vaccines. Mar. 2010;9(3):299-307. doi: 10.1586/erv.09.163. Author Manuscript, 16 pages.

Hirohashi et al., An HLA-A24-restricted cytotoxic T lymphocyte epitope of a tumor-associated protein, survivin. Clin Cancer Res. Jun. 2002;8(6):1731-9.

Hong et al., Novel recombinant hepatitis B virus vectors efficiently deliver protein and RNA encoding genes into primary hepatocytes. J Virol. Jun. 2013;87(12):6615-24. doi: 10.1128/JVI.03328-12. Epub Apr. 3, 2013.

Indikova et al., Highly efficient 'hit-and-run' genome editing with unconcentrated lentivectors carrying Vpr.Prot.Cas9 protein produced from RRE-containing transcripts. Nucleic Acids Res. Aug. 20, 2020;48(14):8178-8187. doi: 10.1093/nar/gkaa561.

Jacobs et al., DNA glycosylases: in DNA repair and beyond. Chromosoma. Feb. 2012;121(1):1-20. doi: 10.1007/s00412-011-0347-4. Epub Nov. 3, 2011. 20 pages.

Jalaguier et al., Efficient production of HIV-1 virus-like particles from a mammalian expression vector requires the N-terminal capsid domain. PLoS One. 2011;6(11):e28314. doi: 10.1371/journal.pone.0028314. Epub Nov. 30, 2011.

Jaramillo et al., Identification of HLA-A3-restricted CD8+ T cell epitopes derived from mammaglobin-A, a tumor-associated antigen of human breast cancer. Int J Cancer. Dec. 10, 2002;102(5):499-506. doi: 10.1002/ijc.10736.

Jeong et al., Current Status and Challenges of DNA Base Editing Tools. Mol Ther. Sep. 2, 2020;28(9):1938-1952. doi: 10.1016/j.ymthe.2020.07.021. Epub Jul. 23, 2020.

Joglekar et al., Pseudotyped Lentiviral Vectors: One Vector, Many Guises. Hum Gene Ther Methods. Dec. 2017;28(6):291-301. doi: 10.1089/hgtb.2017.084. Epub Sep. 4, 2017.

Kaczmarczyk et al., Protein delivery using engineered virus-like particles. Proc Natl Acad Sci U S A. Oct. 11, 2011;108(41):16998-7003. doi: 10.1073/pnas.1101874108. Epub Sep. 26, 2011.

Kang et al., Chimeric rabies virus-like particles containing membrane-anchored GM-CSF enhances the immune response against rabies virus. Viruses. Mar. 11, 2015;7(3):1134-52. doi: 10.3390/v7031134.

Kang et al., Identification of a tyrosinase epitope recognized by HLA-A24-restricted, tumor-infiltrating lymphocytes. J Immunol. Aug. 1, 1995;155(3):1343-8.

Karbach et al., Long-term complete remission following radiosurgery and immunotherapy in a melanoma patient with brain metastasis: immunologic correlates. Cancer Immunol Res. May 2014;2(5):404-9. doi: 10.1158/2326-6066.CIR-13-0200. Epub Feb. 5, 2014.

Kato et al., A lentiviral strategy for highly efficient retrograde gene transfer by pseudotyping with fusion envelope glycoprotein. Hum Gene Ther. Feb. 2011;22(2):197-206. doi: 10.1089/hum.2009.179. Epub Jan. 27, 2011.

Kato et al., Selective neural pathway targeting reveals key roles of thalamostriatal projection in the control of visual discrimination. J Neurosci. Nov. 23, 2011;31(47):17169-79. doi: 10.1523/JNEUROSCI.4005-11.2011.

Kawakami et al., Identification of a human melanoma antigen recognized by tumor-infiltrating lymphocytes associated with in vivo tumor rejection. Proc Natl Acad Sci U S A. Jul. 5, 1994;91(14):6458-62. doi: 10.1073/pnas.91.14.6458.

Kawakami et al., Identification of new melanoma epitopes on melanosomal proteins recognized by tumor infiltrating T lymphocytes restricted by HLA-A1, -A2, and -A3 alleles. J Immunol. Dec. 15, 1998;161(12):6985-92.

Kawakami et al., Identification of the immunodominant peptides of the MART-1 human melanoma antigen recognized by the majority of HLA-A2-restricted tumor infiltrating lymphocytes. J Exp Med. Jul. 1, 1994;180(1):347-52. doi: 10.1084/jem.180.1.347.

Kawakami et al., Recognition of multiple epitopes in the human melanoma antigen gp100 by tumor-infiltrating T lymphocytes associated with in vivo tumor regression. J Immunol. Apr. 15, 1995;154(8):3961-8.

Kawashima et al., Identification of gp100-derived, melanoma-specific cytotoxic T-lymphocyte epitopes restricted by HLA-A3 supertype molecules by primary in vitro immunization with peptide-pulsed dendritic cells. Int J Cancer. Nov. 9, 1998;78(4):518-24. doi: 10.1002/(sici)1097-0215(19981109)78:4<518::aid-ijc20>3.0.co;2-0.

Kawashima et al., Identification of HLA-A3-restricted cytotoxic T lymphocyte epitopes from carcinoembryonic antigen and HER-2/neu by primary in vitro immunization with peptide-pulsed dendritic cells. Cancer Res. Jan. 15, 1999;59(2):431-5.

Kawashima et al., The multi-epitope approach for immunotherapy for cancer: identification of several CTL epitopes from various tumor-associated antigens expressed on solid epithelial tumors. Hum Immunol. Jan. 1998;59(1):1-14. doi: 10.1016/s0198-8859(97)00255-3.

Kemmler et al., Elevated tumor-associated antigen expression suppresses variant peptide vaccine responses. J Immunol. Nov. 1, 2011;187(9):4431-9. doi: 10.4049/jimmunol.1101555. Epub Sep. 21, 2011.

Kittlesen et al., Human melanoma patients recognize an HLA-A1-restricted CTL epitope from tyrosinase containing two cysteine residues: implications for tumor vaccine development. J Immunol. Mar. 1, 1998;160(5):2099-106. Erratum in: J Immunol Mar. 1, 1999;162(5):3106. Shabanowitz JA [corrected to Shabanowitz J].

Kizer et al., Application of functional genomics to pathway optimization for increased isoprenoid production. Appl Environ Microbiol. May 2008;74(10):3229-41. doi: 10.1128/AEM.02750-07. Epub Mar. 14, 2008.

Kobayashi et al., CD4+ T cells from peripheral blood of a melanoma patient recognize peptides derived from nonmutated tyrosinase. Cancer Res. Jan. 15, 1998;58(2):296-301.

Kobayashi et al., Identification of an antigenic epitope for helper T lymphocytes from carcinoembryonic antigen. Clin Cancer Res. Oct. 2002;8(10):3219-25.

Kobayashi et al., Identification of helper T-cell epitopes that encompass or lie proximal to cytotoxic T-cell epitopes in the gp100 melanoma tumor antigen. Cancer Res. Oct. 15, 2001;61(20):7577-84.

Kotterman et al., Engineering adeno-associated viruses for clinical gene therapy. Nat Rev Genet. Jul. 2014;15(7):445-51. doi: 10.1038/nrg3742. Epub May 20, 2014.

(56) References Cited

OTHER PUBLICATIONS

Kueh et al., The new editor-targeted genome engineering in the absence of homology-directed repair. Cell Death Discov. Jun. 13, 2016;2:16042. doi: 10.1038/cddiscovery.2016.42.

Kurt et al., CRISPR C-to-G base editors for inducing targeted DNA transversions in human cells. Nat Biotechnol. Jan. 2021;39(1):41-46. doi: 10.1038/s41587-020-0609-x. Epub Jul. 20, 2020.

Kushnir et al., Virus-like particles as a highly efficient vaccine platform: diversity of targets and production systems and advances in clinical development. Vaccine. Dec. 17, 2012;31(1):58-83. doi: 10.1016/j.vaccine.2012.10.083. Epub Nov. 6, 2012.

Lally et al., Unmasking cryptic epitopes after loss of immunodominant tumor antigen expression through epitope spreading. Int J Cancer. Sep. 2001;93(6):841-7. doi: 10.1002/ijc.1420.

Lapointe et al., Retrovirally transduced human dendritic cells can generate T cells recognizing multiple MHC class I and class II epitopes from the melanoma antigen glycoprotein 100. J Immunol. Oct. 15, 2001;167(8):4758-64. doi: 10.4049/jimmunol.167.8.4758.

Larrieu et al., A HLA-Cw*0701 restricted Melan-A/MART1 epitope presented by melanoma tumor cells to CD8+ tumor infiltrating lymphocytes. Cancer Immunol Immunother. May 2008;57(5):745-52. doi: 10.1007/s00262-007-0436-7. Epub Dec. 21, 2007.

Latham et al., Formation of wild-type and chimeric influenza virus-like particles following simultaneous expression of only four structural proteins. J Virol. Jul. 2001;75(13):6154-65. doi: 10.1128/JVI.75.13.6154-6165.2001.

Lennerz et al., The response of autologous T cells to a human melanoma is dominated by mutated neoantigens. Proc Natl Acad Sci U S A. Nov. 1, 2005;102(44):16013-8. doi: 10.1073/pnas.0500090102. Epub Oct. 24, 2005.

Li et al., Base-Resolution Mapping Reveals Distinct m1A Methylome in Nuclear- and Mitochondrial-Encoded Transcripts. Mol Cell. Dec. 7, 2017;68(5):993-1005.e9. doi: 10.1016/j.molcel.2017.10.019. Epub Nov. 5, 2017.

Li et al., Expression and self-assembly of empty virus-like particles of hepatitis E virus. J Virol. Oct. 1997;71(10):7207-13. doi: 10.1128/JVI.71.10.7207-7213.1997.

Lin et al., HLA-DPB1*05: 01-restricted WT1332-specific TCR-transduced CD4+ T lymphocytes display a helper activity for WT1-specific CTL induction and a cytotoxicity against leukemia cells. J Immunother. Apr. 2013;36(3):159-70. doi: 10.1097/CJI.0b013e3182873581.

Lu, Periodic Chart of Amino Acid PDF. Accessed on the internet at https://figshare.com/articles/figure/periodic_chart_of_amino_acid_pdf/3445001/1. Posted Jun. 21, 2016. www.bachem.com. 1 page.

Ludwig et al., Virus-like particles-universal molecular toolboxes. Curr Opin Biotechnol. Dec. 2007;18(6):537-45. doi: 10.1016/j.copbio.2007.10.013.

Lueck et al., Engineered transfer RNAs for suppression of premature termination codons. Nat Commun. Feb. 18, 2019;10(1):822. doi: 10.1038/s41467-019-08329-4.

Lupetti et al., Translation of a retained intron in tyrosinase-related protein (TRP) 2 mRNA generates a new cytotoxic T lymphocyte (CTL)-defined and shared human melanoma antigen not expressed in normal cells of the melanocytic lineage. J Exp Med. Sep. 21, 1998;188(6):1005-16. doi: 10.1084/jem.188.6.1005.

Lyu et al., Delivering Cas9/sgRNA ribonucleoprotein (RNP) by lentiviral capsid-based bionanoparticles for efficient 'hit-and-run' genome editing. Nucleic Acids Res. Sep. 26, 2019;47(17):e99. doi: 10.1093/nar/gkz605.

Maetzig et al., Retroviral protein transfer: falling apart to make an impact. Curr Gene Ther. Oct. 2012;12(5):389-409. doi: 10.2174/156652312802762581.

Mandic et al., The alternative open reading frame of LAGE-1 gives rise to multiple promiscuous HLA-DR-restricted epitopes recognized by T-helper 1-type tumor-reactive CD4+ T cells. Cancer Res. Oct. 1, 2003;63(19):6506-15.

Mangeot et al., A universal transgene silencing method based on RNA interference. Nucleic Acids Res. Jul. 12, 2004;32(12):e102. doi: 10.1093/nar/gnh105.

Mangeot et al., Development of minimal lentivirus vectors derived from simian immunodeficiency virus (SIVmac251) and their use for gene transfer into human dendritic cells. J Virol. Sep. 2000;74(18):8307-15. doi: 10.1128/jvi.74.18.8307-8315.2000.

Mangeot et al., Protein transfer into human cells by VSV-G-induced nanovesicles. Mol Ther. Sep. 2011;19(9):1656-66. doi: 10.1038/mt.2011.138. Epub Jul. 12, 2011.

Meng et al., Identification of an HLA-DPB1*0501 restricted Melan-A/MART-1 epitope recognized by CD4+ T lymphocytes: prevalence for immunotherapy in Asian populations. J Immunother. Sep. 2011;34(7):525-34. doi: 10.1097/CJI.0b013e318226bd45. Author Manuscript. 16 pages.

Michaux et al., A spliced antigenic peptide comprising a single spliced amino acid is produced in the proteasome by reverse splicing of a longer peptide fragment followed by trimming. J Immunol. Feb. 15, 2014;192(4):1962-71. doi: 10.4049/jimmunol.1302032. Epub Jan. 22, 2014.

Milone et al., Clinical use of lentiviral vectors. Leukemia. Jul. 2018;32(7):1529-1541. doi: 10.1038/s41375-018-0106-0. Epub Mar. 22, 2018.

Momose et al., Diving into marine genomics with CRISPR/Cas9 systems. Mar Genomics. Dec. 2016;30:55-65. doi: 10.1016/j.margen.2016.10.003. Epub Oct. 12, 2016.

Morel et al., A tyrosinase peptide presented by HLA-B35 is recognized on a human melanoma by autologous cytotoxic T lymphocytes. Int J Cancer. Dec. 10, 1999;83(6):755-9. doi: 10.1002/(sici)1097-0215(19991210)83:6<755::aid-ijc10>3.0.co;2-s.

Mselli-Lakhal et al., Gene transfer system derived from the caprine arthritis-encephalitis lentivirus. J Virol Methods. Sep. 2006;136(1-2):177-84. doi: 10.1016/j.jviromet.2006.05.006. Epub Jun. 21, 2006.

Murawski et al., Newcastle disease virus-like particles containing respiratory syncytial virus G protein induced protection in BALB/c mice, with no evidence of immunopathology. J Virol. Jan. 2010;84(2):1110-23. doi: 10.1128/JVI.01709-09. Epub Nov. 4, 2009.

Naskalska et al., Virus Like Particles as Immunogens and Universal Nanocarriers. Pol J Microbiol. 2015;64(1):3-13.

Negre et al., Characterization of novel safe lentiviral vectors derived from simian immunodeficiency virus (SIVmac251) that efficiently transduce mature human dendritic cells. Gene Ther. Oct. 2000;7(19):1613-23. doi: 10.1038/sj.gt.3301292.

Noppen et al., Naturally processed and concealed HLA-A2.1-restricted epitopes from tumor-associated antigen tyrosinase-related protein-2. Int J Cancer. Jul. 15, 2000;87(2):241-6.

Nukaya et al., Identification of HLA-A24 epitope peptides of carcinoembryonic antigen which induce tumor-reactive cytotoxic T lymphocyte. Int J Cancer. Jan. 5, 1999;80(1):92-7. doi: 10.1002/(sici)1097-0215(19990105)80:1<92::aid-ijc18>3.0.co;2-m.

Ogasawara et al., Recombinant viral-like particles of parvovirus B19 as antigen carriers of anthrax protective antigen. In Vivo. May-Jun. 2006;20(3):319-24.

Ohminami et al., HLA class I-restricted lysis of leukemia cells by a CD8(+) cytotoxic T-lymphocyte clone specific for WT1 peptide. Blood. Jan. 1, 2000;95(1):286-93.

Oka et al., WT1 peptide vaccine for the treatment of cancer. Curr Opin Immunol. Apr. 2008;20(2):211-20. doi: 10.1016/j.coi.2008.04.009. Epub May 24, 2008.

Olsen, J.C., Gene transfer vectors derived from equine infectious anemia virus. Gene Ther. Nov. 1998;5(11):1481-7. doi: 10.1038/sj.gt.3300768.

Olson et al., HLA-A2-restricted T-cell epitopes specific for prostatic acid phosphatase. Cancer Immunol Immunother. Jun. 2010;59(6):943-53. doi: 10.1007/s00262-010-0820-6. Epub Feb. 6, 2010.

Osen et al., Screening of human tumor antigens for CD4 T cell epitopes by combination of HLA-transgenic mice, recombinant adenovirus and antigen peptide libraries. PLoS One. Nov. 30, 2010;5(11):e14137. doi: 10.1371/journal.pone.0014137.

Parkhurst et al., Identification of a shared HLA-A*0201-restricted T-cell epitope from the melanoma antigen tyrosinase-related protein 2 (TRP2). Cancer Res. Nov. 1, 1998;58(21):4895-901.

Parkhurst et al., Induction of CD4+ Th1 lymphocytes that recognize known and novel class II MHC restricted epitopes from the melanoma antigen gp100 by stimulation with recombinant protein. J

(56) References Cited

OTHER PUBLICATIONS

Immunother. Mar.-Apr. 2004;27(2):79-91. doi: 10.1097/00002371-200403000-00001. Author Manuscript. 22 pages.

Paschen et al., Detection of spontaneous CD4+ T-cell responses in melanoma patients against a tyrosinase-related protein-2-derived epitope identified in HLA-DRB1*0301 transgenic mice. Clin Cancer Res. Jul. 15, 2005;11(14):5241-7. doi: 10.1158/1078-0432.CCR-05-0170.

Pavlov et al., Roles of DNA polymerases in replication, repair, and recombination in eukaryotes. Int Rev Cytol. 2006;255:41-132. doi: 10.1016/S0074-7696(06)55002-8.

Pinilla et al., Combinatorial peptide libraries as an alternative approach to the identification of ligands for tumor-reactive cytolytic T lymphocytes. Cancer Res. Jul. 1, 2001;61(13):5153-60.

Pinilla-Ibarz et al., Improved human T-cell responses against synthetic HLA-0201 analog peptides derived from the WT1 oncoprotein. Leukemia. Nov. 2006;20(11):2025-33. doi: 10.1038/sj.leu.2404380. Epub Aug. 31, 2006.

Prather et al., De novo biosynthetic pathways: rational design of microbial chemical factories. Curr Opin Biotechnol. Oct. 2008;19(5):468-74. doi: 10.1016/j.copbio.2008.07.009. Epub Sep. 5, 2008.

Quan et al., Influenza M1 VLPs containing neuraminidase induce heterosubtypic cross-protection. Virology. Sep. 1, 2012;430(2):127-35. doi: 10.1016/j.virol.2012.05.006. Epub Jun. 2, 2012.

Rasmussen et al., Characterization of virus-like particles produced by a recombinant baculovirus containing the gag gene of the bovine immunodeficiency-like virus. Virology. Oct. 1990; 178(2):435-51. doi: 10.1016/0042-6822(90)90341-n.

Remington et al., Complete nucleotide sequence of a neuropathogenic variant of Friend murine leukemia virus PVC-211. Nucleic Acids Res. Jun. 25, 1992;20(12):3249. doi: 10.1093/nar/20.12.3249.

Renner et al., Intact Viral Particle Counts Measured by Flow Virometry Provide Insight into the Infectivity and Genome Packaging Efficiency of Moloney Murine Leukemia Virus. J Virol. Jan. 6, 2020;94(2):e01600-19. doi: 10.1128/JVI.01600-19.

Riley et al., Identification of a new shared HLA-A2.1 restricted epitope from the melanoma antigen tyrosinase. J Immunother. May 20-Jun. 2001;24(3):212-20.

Rimoldi et al., Efficient simultaneous presentation of NY-ESO-1/LAGE-1 primary and nonprimary open reading frame-derived CTL epitopes in melanoma. J Immunol. Dec. 15, 2000;165(12):7253-61. doi: 10.4049/jimmunol.165.12.7253.

Robbins et al., Multiple HLA class II-restricted melanocyte differentiation antigens are recognized by tumor-infiltrating lymphocytes from a patient with melanoma. J Immunol. Nov. 15, 2002;169(10):6036-47. doi: 10.4049/jimmunol.169.10.6036.

Robbins et al., The intronic region of an incompletely spliced gp100 gene transcript encodes an epitope recognized by melanoma-reactive tumor-infiltrating lymphocytes. J Immunol. Jul. 1, 1997;159(1):303-8.

Rohovie et al., Virus-like particles: Next-generation nanoparticles for targeted therapeutic delivery. Bioeng Transl Med. Jan. 19, 2017;2(1):43-57. doi: 10.1002/btm2.10049.

Rosenberg et al., Immunologic and therapeutic evaluation of a synthetic peptide vaccine for the treatment of patients with metastatic melanoma. Nat Med. Mar. 1998;4(3):321-7. doi: 10.1038/nm0398-321.

Rubio-Godoy et al., Toward synthetic combinatorial peptide libraries in positional scanning format (PS-SCL)-based identification of CD8+ Tumor-reactive T-Cell Ligands: a comparative analysis of PS-SCL recognition by a single tumor-reactive CD8+ cytolytic T-lymphocyte clone. Cancer Res. Apr. 1, 2002;62(7):2058-63.

Ruiz et al., Identification and characterization of a T-helper peptide from carcinoembryonic antigen. Clin Cancer Res. Apr. 15, 2004;10(8):2860-7. doi: 10.1158/1078-0432.ccr-03-0476.

Rusk, Cas9 and the importance of asymmetry. Nat Methods. Apr. 2016;13(4):286-7. doi: 10.1038/nmeth.3826.

Saenger et al., Improved tumor immunity using anti-tyrosinase related protein-1 monoclonal antibody combined with DNA vaccines in murine melanoma. Cancer Res. Dec. 1, 2008;68(23):9884-91. doi: 10.1158/0008-5472.CAN-08-2233. Author Manuscript. 19 pages.

Saenz et al., Feline immunodeficiency virus-based lentiviral vectors. Cold Spring Harb Protoc. Jan. 1, 2012;2012(1):71-6. doi: 10.1101/pdb.ip067579.

Saenz et al., Production, harvest, and concentration of feline immunodeficiency virus-based lentiviral vector from cells grown in CF10 or CF2 devices. Cold Spring Harb Protoc. Jan. 1, 2012;2012(1):118-23. doi: 10.1101/pdb.prot067546.

Sakuma et al., Multiplex genome engineering in human cells using all-in-one CRISPR/Cas9 vector system. Sci Rep. Jun. 23, 2014;4:5400. doi: 10.1038/srep05400.

Schneider et al., Overlapping peptides of melanocyte differentiation antigen Melan-A/MART-1 recognized by autologous cytolytic T lymphocytes in association with HLA-B45.1 and HLA-A2.1. Int J Cancer. Jan. 30, 1998;75(3):451-8. doi: 10.1002/(sici)1097-0215(19980130)75:3<451::aid-ijc20>3.0.co;2-a.

Sensi et al., Identification of a novel gp100/pMel17 peptide presented by HLA-A*6801 and recognized on human melanoma by cytolytic T cell clones. Tissue Antigens. Apr. 2002;59(4):273-9. doi: 10.1034/j.1399-0039.2002.590404.x.

Shang et al., The spontaneous CD8+ T-cell response to HLA-A2-restricted NY-ESO-1b peptide in hepatocellular carcinoma patients. Clin Cancer Res. Oct. 15, 2004;10(20):6946-55. doi: 10.1158/1078-0432.CCR-04-0502.

Sharma et al., Noninfectious virus-like particles produced by Moloney murine leukemia virus-based retrovirus packaging cells deficient in viral envelope become infectious in the presence of lipofection reagents. Proc Natl Acad Sci U S A. Sep. 30, 1997;94(20):10803-8. doi: 10.1073/pnas.94.20.10803.

Shellenberger et al., A recombinant polypeptide extends the in vivo half-life of peptides and proteins in a tunable manner. Nat Biotechnol. Dec. 2009;27(12):1186-90. doi: 10.1038/nbt.1588.

Shen et al., Identification of a MHC class-II restricted epitope in carcinoembryonic antigen. Cancer Immunol Immunother. May 2004;53(5):391-403. doi: 10.1007/s00262-003-0455-y. Epub Nov. 18, 2003.

Shim et al., Nonviral Delivery Systems for Cancer Gene Therapy: Strategies and Challenges. Curr Gene Ther. 2018;18(1):3-20. doi: 10.2174/1566523218666180119121949.

Skipper et al., An HLA-A2-restricted tyrosinase antigen on melanoma cells results from posttranslational modification and suggests a novel pathway for processing of membrane proteins. J Exp Med. Feb. 1, 1996;183(2):527-34. doi: 10.1084/jem.183.2.527.

Skipper et al., Shared epitopes for HLA-A3-restricted melanoma-reactive human CTL include a naturally processed epitope from Pmel-17/gp100. J Immunol. Dec. 1, 1996;157(11):5027-33.

Slansky et al., Enhanced antigen-specific antitumor immunity with altered peptide ligands that stabilize the MHC-peptide-TCR complex. Immunity. Oct. 2000; 13(4):529-38. doi: 10.1016/s1074-7613(00)00052-2.

Slingluff et al., Clinical and immunologic results of a randomized phase II trial of vaccination using four melanoma peptides either administered in granulocyte-macrophage colony-stimulating factor in adjuvant or pulsed on dendritic cells. J Clin Oncol. Nov. 1, 2003;21(21):4016-26. doi: 10.1200/JCO.2003.10.005.

Slingluff et al., Immunologic and clinical outcomes of vaccination with a multiepitope melanoma peptide vaccine plus low-dose interleukin-2 administered either concurrently or on a delayed schedule. J Clin Oncol. Nov. 15, 2004;22(22):4474-85. doi: 10.1200/JCO.2004.10.212.

Stevens et al., Design of a Split Intein with Exceptional Protein Splicing Activity. J Am Chem Soc. Feb. 24, 2016;138(7):2162-5. doi: 10.1021/jacs.5b13528. Epub Feb. 8, 2016. Abstract Only. 1 page.

Tang et al., The *Arabidopsis* TRM61/TRM6 complex is a bona fide tRNA N1-methyladenosine methyltransferase. J Exp Bot. May 30, 2020;71(10):3024-3036. doi: 10.1093/jxb/eraa100.

Tangri et al., Structural features of peptide analogs of human histocompatibility leukocyte antigen class I epitopes that are more potent and immunogenic than wild-type peptide. J Exp Med. Sep. 17, 2001;194(6):833-46. doi: 10.1084/jem.194.6.833.

(56) References Cited

OTHER PUBLICATIONS

Tomé-Amat et al., Secreted production of assembled Norovirus virus-like particles from Pichia pastoris. Microb Cell Fact. Sep. 10, 2014;13:134. doi: 10.1186/s12934-014-0134-z.
Topalian et al., Melanoma-specific CD4+ T cells recognize nonmutated HLA-DR-restricted tyrosinase epitopes. J Exp Med. May 1, 1996;183(5):1965-71. doi: 10.1084/jem.183.5.1965.
Touloukian et al., Expression of a "self-"antigen by human tumor cells enhances tumor antigen-specific CD4(+) T-cell function. Cancer Res. Sep. 15, 2002;62(18):5144-7. Author Manuscript. 11 pages.
Touloukian et al., Identification of a MHC class II-restricted human gp100 epitope using DR4-IE transgenic mice. J Immunol. Apr. 1, 2000;164(7):3535-42. doi: 10.4049/jimmunol.164.7.3535.
Touloukian et al., Normal tissue depresses while tumor tissue enhances human T cell responses in vivo to a novel self/tumor melanoma antigen, OA1. J Immunol. Feb. 1, 2003;170(3):1579-85. doi: 10.4049/jimmunol.170.3.1579.
Trojan et al., Generation of cytotoxic T lymphocytes against native and altered peptides of human leukocyte antigen-A*0201 restricted epitopes from the human epithelial cell adhesion molecule. Cancer Res. Jun. 15, 2001;61(12):4761-5.
Tsai et al., Identification of subdominant CTL epitopes of the GP100 melanoma-associated tumor antigen by primary in vitro immunization with peptide-pulsed dendritic cells. J Immunol. Feb. 15, 1997;158(4):1796-802.
Tsang et al., A human cytotoxic T-lymphocyte epitope and its agonist epitope from the nonvariable number of tandem repeat sequence of MUC-1. Clin Cancer Res. Mar. 15, 2004;10(6):2139-49. doi: 10.1158/1078-0432.ccr-1011-03.
Tsang et al., Generation of human cytotoxic T cells specific for human carcinoembryonic antigen epitopes from patients immunized with recombinant vaccinia-CEA vaccine. J Natl Cancer Inst. Jul. 5, 1995;87(13):982-90. doi: 10.1093/jnci/87.13.982.
Tsuboi et al., Enhanced induction of human WT1-specific cytotoxic T lymphocytes with a 9-mer WT1 peptide modified at HLA-A*2402-binding residues. Cancer Immunol Immunother. Dec. 2002;51(11-12):614-20. doi: 10.1007/s00262-002-0328-9. Epub Oct. 18, 2002.
Tuorto et al., Genome recoding by tRNA modifications. Open Biol. Dec. 2016;6(12):160287. doi: 10.1098/rsob.160287.
Tycko et al., Methods for Optimizing CRISPR-Cas9 Genome Editing Specificity. Mol Cell. Aug. 4, 2016;63(3):355-70. doi: 10.1016/j.molcel.2016.07.004.
Valmori et al., Analysis of the cytolytic T lymphocyte response of melanoma patients to the naturally HLA-A*0201-associated tyrosinase peptide 368-376. Cancer Res. Aug. 15, 1999;59(16):4050-5.
Valmori et al., Enhanced generation of specific tumor-reactive CTL in vitro by selected Melan-A/MART-1 immunodominant peptide analogues. J Immunol. Feb. 15, 1998;160(4):1750-8.
Valmori et al., Naturally occurring human lymphocyte antigen-A2 restricted CD8+ T-cell response to the cancer testis antigen NY-ESO-1 in melanoma patients. Cancer Res. Aug. 15, 2000;60(16):4499-506.
Vigneron et al., A peptide derived from melanocytic protein gp100 and presented by HLA-B35 is recognized by autologous cytolytic T lymphocytes on melanoma cells. Tissue Antigens. Feb. 2005;65(2):156-62. doi: 10.1111/j.1399-0039.2005.00365.x.
Vigneron et al., An antigenic peptide produced by peptide splicing in the proteasome. Science. Apr. 23, 2004;304(5670):587-90. doi: 10.1126/science.1095522.
Visseren et al., Affinity, specificity and T-cell-receptor diversity of melanoma-specific CTL generated in vitro against a single tyrosinase epitope. Int J Cancer. Sep. 17, 1997;72(6):1122-8. doi: 10.1002/(sici)1097-0215(19970917)72:6<1122::aid-ijc30>3.0.co;2-3.
Voelkel et al., Protein transduction from retroviral Gag precursors. Proc Natl Acad Sci U S A. Apr. 27, 2010;107(17):7805-10. doi: 10.1073/pnas.0914517107. Epub Apr. 12, 2010.
Volpe et al., Alternative BCR/ABL splice variants in Philadelphia chromosome-positive leukemias result in novel tumor-specific fusion proteins that may represent potential targets for immunotherapy approaches. Cancer Res. Jun. 1, 2007;67(11):5300-7. doi: 10.1158/0008-5472.CAN-06-3737.
Voutev et al., Bxb1 phage recombinase assists genome engineering in *Drosophila melanogaster*. Biotechniques. Jan. 1, 2017;62(1):37-38. doi: 10.2144/000114494.
Walpita et al., Mammalian Cell-Derived Respiratory Syncytial Virus-Like Particles Protect the Lower as well as the Upper Respiratory Tract. PLoS One. Jul. 14, 2015;10(7):e0130755. doi: 10.1371/journal.pone.0130755.
Walton et al., Spontaneous CD8 T cell responses against the melanocyte differentiation antigen RAB38/NY-MEL-1 in melanoma patients. J Immunol. Dec. 1, 2006;177(11):8212-8. doi: 10.4049/jimmunol.177.11.8212.
Wang et al., CRISPR/Cas9 in Genome Editing and Beyond. Annu Rev Biochem. Jun. 2, 2016;85:227-64. doi: 10.1146/annurev-biochem-060815-014607. Epub Apr. 25, 2016.
Wang et al., CRISPR-Based Therapeutic Genome Editing: Strategies and In Vivo Delivery by AAV Vectors. Cell. Apr. 2, 2020;181(1):136-150. doi: 10.1016/j.cell.2020.03.023.
Wang et al., Recognition of an antigenic peptide derived from tyrosinase-related protein-2 by CTL in the context of HLA-A31 and -A33. J Immunol. Jan. 15, 1998;160(2):890-7.
Wang et al., Recognition of breast cancer cells by CD8+ cytotoxic T-cell clones specific for NY-BR-1. Cancer Res. Jul. 1, 2006;66(13):6826-33. doi: 10.1158/0008-5472.CAN-05-3529.
Wang et al., Utilization of an alternative open reading frame of a normal gene in generating a novel human cancer antigen. J Exp Med. Mar. 1, 1996;183(3):1131-40. doi: 10.1084/jem.183.3.1131.
Wang et al., Virus-like particles for the prevention of human papillomavirus-associated malignancies. Expert Rev Vaccines. Feb. 2013;12(2):129-41. doi: 10.1586/erv.12.151. Author Manuscript, 22 pages.
Wei et al., Systemic nanoparticle delivery of CRISPR-Cas9 ribonucleoproteins for effective tissue specific genome editing. Nat Commun. Jun. 26, 2020;11(1):3232. doi: 10.1038/s41467-020-17029-3.
Wölfel et al., Two tyrosinase nonapeptides recognized on HLA-A2 melanomas by autologous cytolytic T lymphocytes. Eur J Immunol. Mar. 1994;24(3):759-64. doi: 10.1002/eji.1830240340.
Yang et al., HIV-1 virus-like particles produced by stably transfected *Drosophila* S2 cells: a desirable vaccine component. J Virol. Jul. 2012;86(14):7662-76. doi: 10.1128/JVI.07164-11. Epub May 2, 2012.
Yee et al., A general method for the generation of high-titer, pantropic retroviral vectors: highly efficient infection of primary hepatocytes. Proc Natl Acad Sci U S A. Sep. 27, 1994;91(20):9564-8. doi: 10.1073/pnas.91.20.9564.
Yu et al., Poor immunogenicity of a self/tumor antigen derives from peptide-MHC-I instability and is independent of tolerance. J Clin Invest. Aug. 2004; 114(4):551-9. doi: 10.1172/JCI21695.
Zarour et al., Melan-A/MART-1(51-73) represents an immunogenic HLA-DR4-restricted epitope recognized by melanoma-reactive CD4(+) T cells. Proc Natl Acad Sci U S A. Jan. 4, 2000;97(1):400-5. doi: 10.1073/pnas.97.1.400.
Zeltins, A., Construction and characterization of virus-like particles: a review. Mol Biotechnol. Jan. 2013;53(1):92-107. doi: 10.1007/s12033-012-9598-4.
Zhang et al., Cell-specific targeting of lentiviral vectors mediated by fusion proteins derived from Sindbis virus, vesicular stomatitis virus, or avian sarcoma/leukosis virus. Retrovirology. Jan. 25, 2010;7:3. doi: 10.1186/1742-4690-7-3.
Zhao et al., Glycosylase base editors enable C-to-A and C-to-G base changes. Nat Biotechnol. Jan. 2021;39(1):35-40. doi: 10.1038/s41587-020-0592-2. Epub Jul. 20, 2020. Erratum in: Nat Biotechnol. Jan. 2021;39(1):115. doi: 10.1038/s41587-020-0648-3.
Zhao et al., Study on p21 gene knock out in G401 cell line by using CRISPR/Cas9 system. Tianjin Med J. Oct. 2016;44(10):1190-1194.

\* cited by examiner

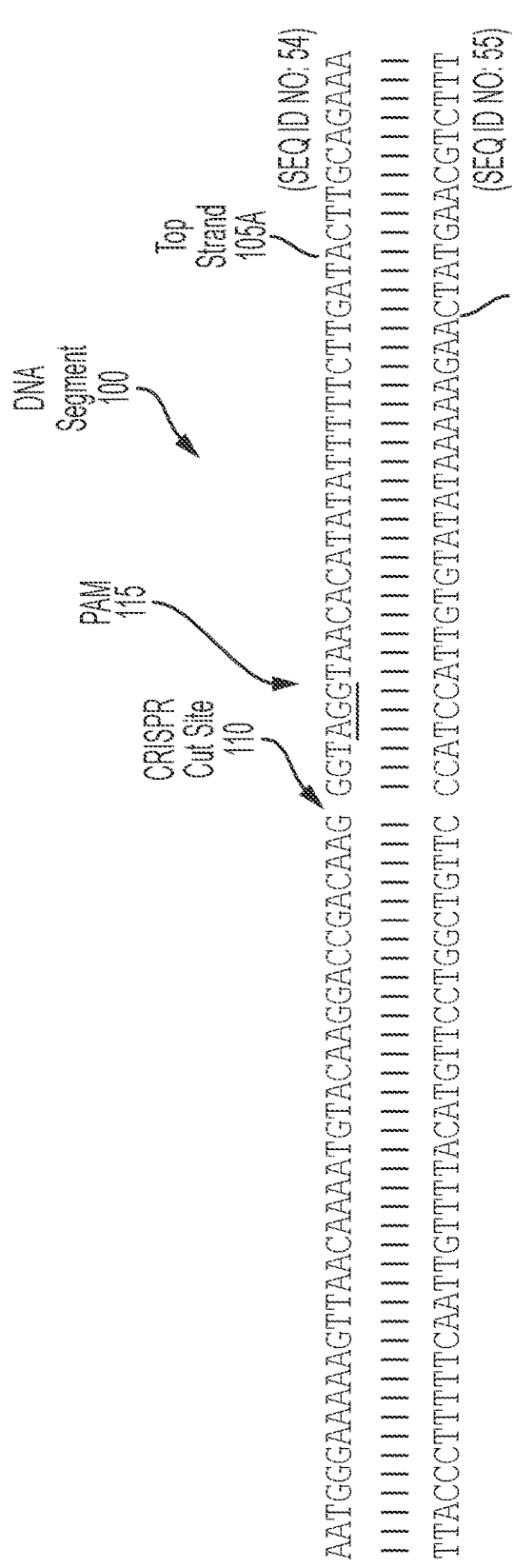
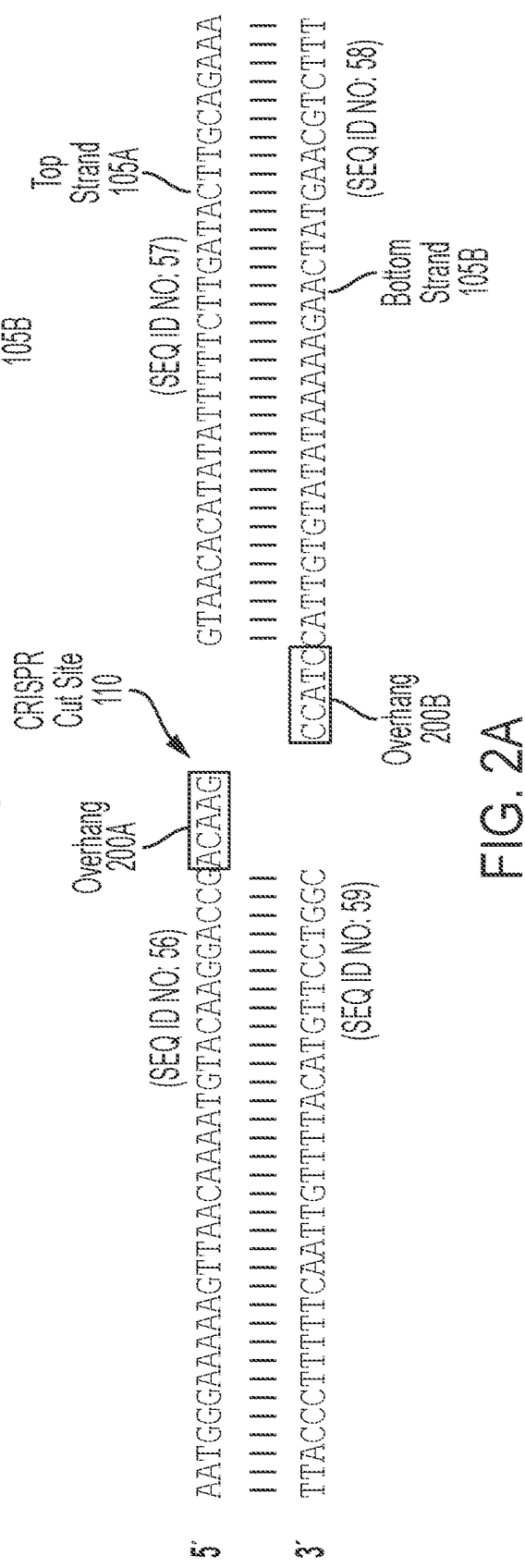
FIG. 1
FIG. 2A

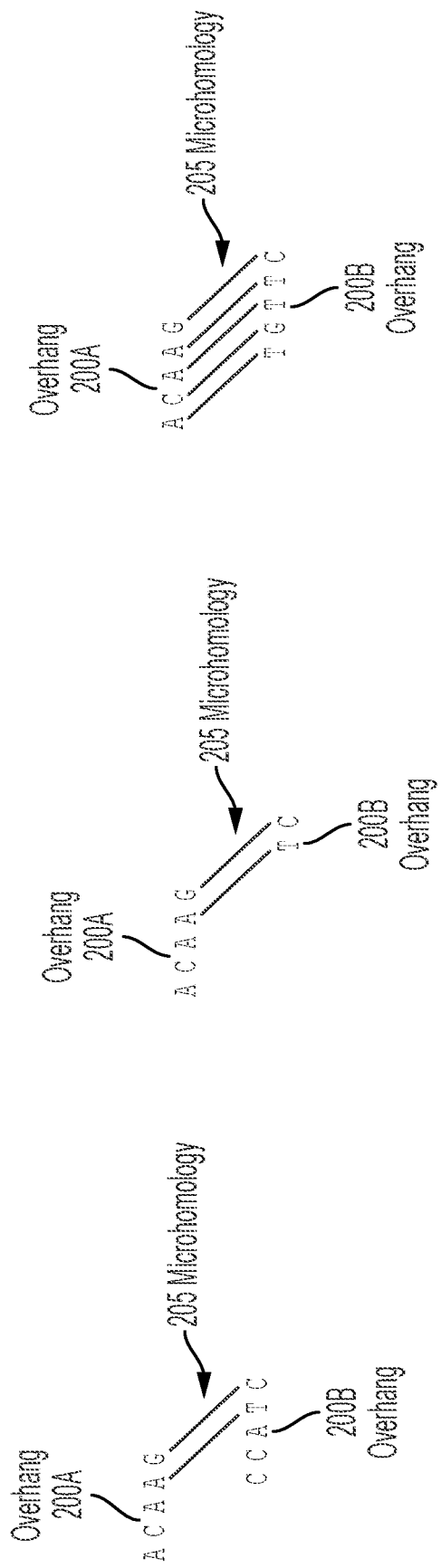

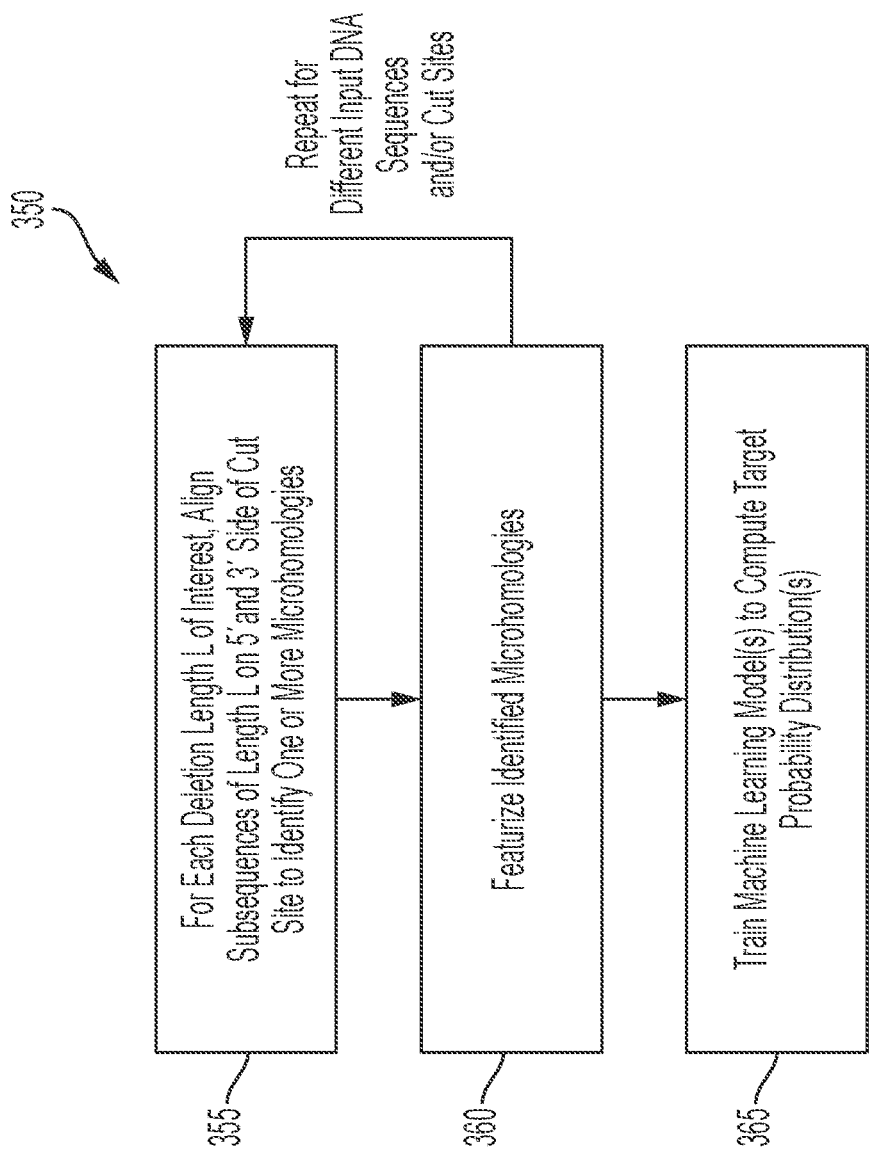

```
CGT C GT CGGT
TGC TG C TGCCA
```
Blunt-end cut

```
ACGTA CGTACGGT
TGCATG CATGCCA
```
1 base pair staggered cut (SEQ ID NO: 60)
```
ACGTACCGTACGGT
TGCATGGCATGCCA
```
(SEQ ID NO: 61)

Polymerase fill-in and ligation (SEQ ID NO: 62)
```
ACGTACCGTACGGT
||||||  |||||||
ACGTAC-GTACGGT
```
(SEQ ID NO: 63)

Alignment of repair product (top) to original sequence (bottom) shows a 1 base pair insertion of "C" which was originally directly on the 5' side (left side) of the cut site

FIG. 7

```
                              ATT
                               ┊   3
                              TGT
                               ┊
                             GATT
                               ┊   4
                             TGTG
                              ┊
                            AGATT  5
                             ┊┊
                            TGTGG
                             ┊┊
                           TAGATT  6
                            ┊┊┊
                           TGTGGG
                            ┊┊┊
                          TTAGATT  7
                           ┊┊┊┊
                          TGTGGGC
                           ┊┊┊┊
                         CTTAGATT  8
                          ┊┊┊┊
                         TGTGGGCT
                          ┊┊┊┊┊
                        GCTTAGATT  9
                         ┊┊┊┊┊
                        TGTGGGCTT
                         ┊┊┊┊┊┊
                       GGCTTAGATT 10
                        ┊┊┊┊┊┊┊
                       TGTGGGCTTA
                        ┊┊┊┊┊┊
                      GGGCTTAGATT 11
                       ┊┊┊┊┊┊┊
                      TGTGGGCTTAG
                       ┊┊┊┊┊┊┊┊
                     TGGGCTTAGATT 12
                      ┊┊┊┊┊┊┊┊
                     TGTGGGCTTAGA
                      ┊┊┊┊┊┊┊┊┊
                    GTGGGCTTAGATT 13
                     ┊┊┊┊┊┊┊┊┊
                    TGTGGGCTTAGAT
                     ┊┊┊┊┊┊┊┊┊┊
                   GGTGGGCTTAGATT 14
                    ┊┊┊┊┊┊┊┊┊┊┊
                   TGTGGGCTTAGATT
                    ┊ ┊┊┊┊ ┊┊┊┊
                  AGGTGGGCTTAGATT 15
                    ┊ ┊┊  ┊┊ ┊┊┊
                  TGTGGCTTAGATTT
                   ┊┊ ┊  ┊  ┊┊
                 TAGGTGGGCTTAGATT 16
                   ┊┊┊ ┊   ┊ ┊
                 TGTGGGCTTAGATTTC
                  ┊ ┊ ┊   ┊  ┊
                TTAGGTGGGCTTAGATT 17
                  ┊   ┊     ┊
                TGTGGGCTTAGATTTCT
                 ┊         ┊
               ATTAGGTGGGCTTAGATT 18
                 ┊┊┊       ┊
               TGTGGGCTTAGATTTCTA
               AATTAGGTGGGCTTAGATT 19
                 ┊ ┊
               TGTGGGCTTAGATTTCTAC
              CAATTAGGTGGGCTTAGATT 20
                 ┊ ┊┊┊   ┊┊
              TGTGGGCTTAGATTTCTACT
             ACAATTAGGTGGGCTTAGATT 21
                ┊ ┊
              TGTGGGCTTAGATTTCTACTG
             TACAATTAGGTGGGCTTAGATT 22
                ┊   ┊┊
              TGTGGGCTTAGATTTCTACTGA
             GTACAATTAGGTGGGCTTAGATT 23
                ┊
              TGTGGGCTTAGATTTCTACTGAC
            AGTACAATTAGGTGGGCTTAGATT 24
                ┊┊ ┊┊┊┊┊ ┊        ┊┊
              TGTGGGCTTAGATTTCTACTGACT
            CAGTACAATTAGGTGGGCTTAGATT 25
                ┊      ┊
              TGTGGGCTTAGATTTCTACTGACTA
            TCAGTACAATTAGGTGGGCTTAGATT 26
                ┊        ┊┊  ┊┊
              TGTGGGCTTAGATTTCTACTGACTAC
```

Starting here, sequences correspond from top to bottom to SEQ ID NOs: 65-98.

Alignments of 5' and 3' sides of cut site from 3bp to 26bp shows a large microhomology at 14bp

FIG. 8D

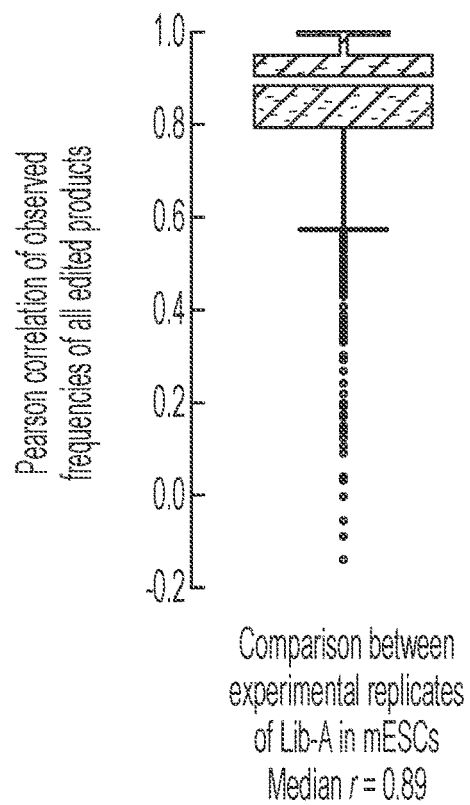
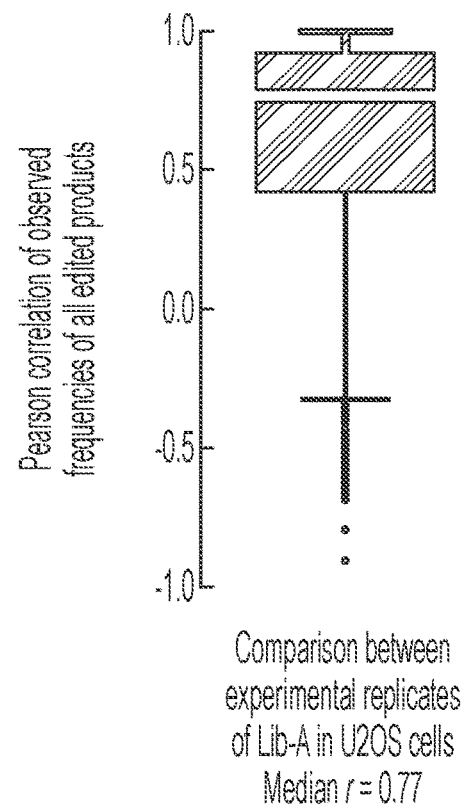
FIG. 16F

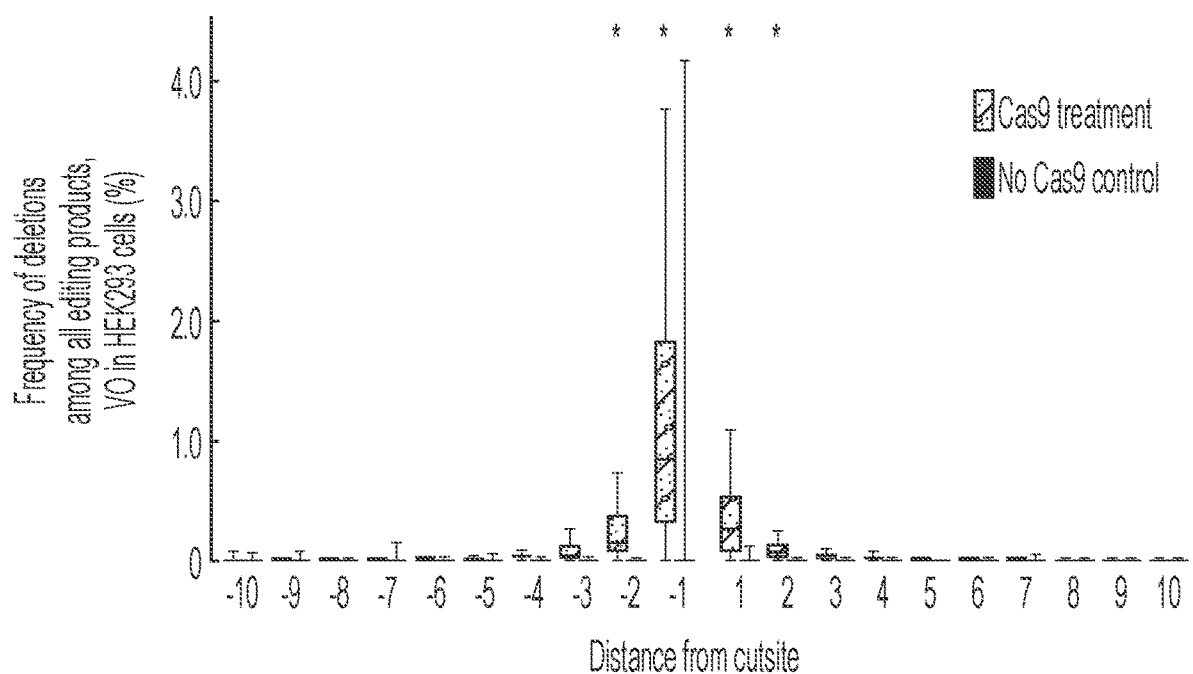
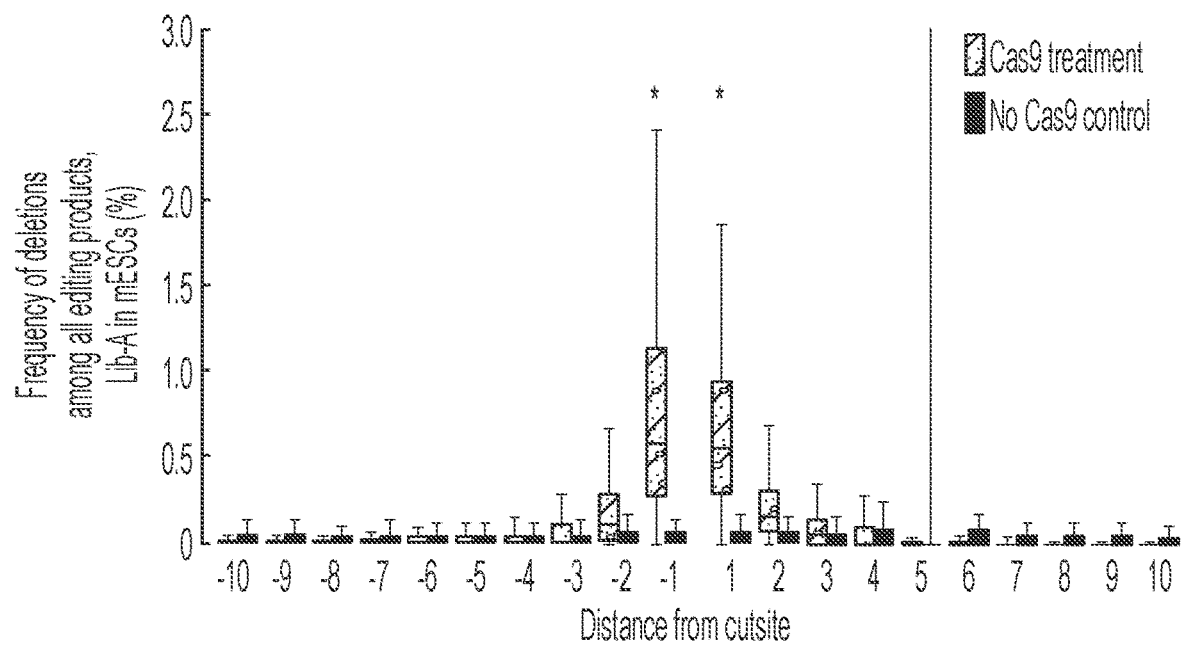
FIG. 17D

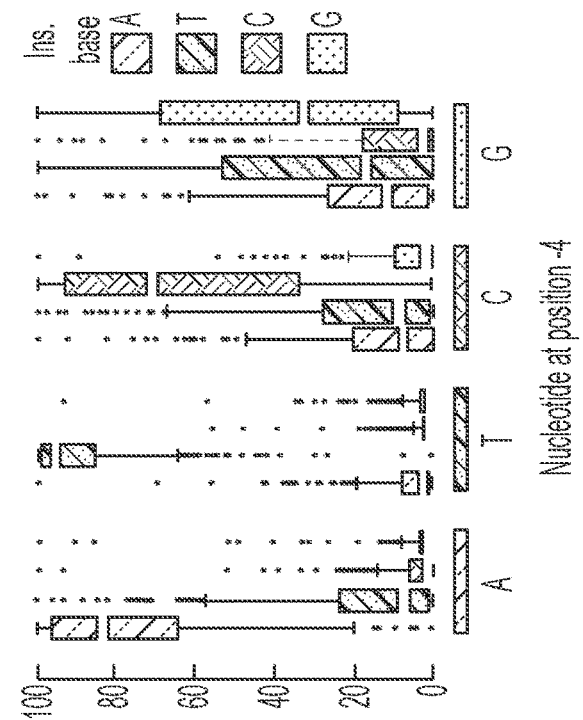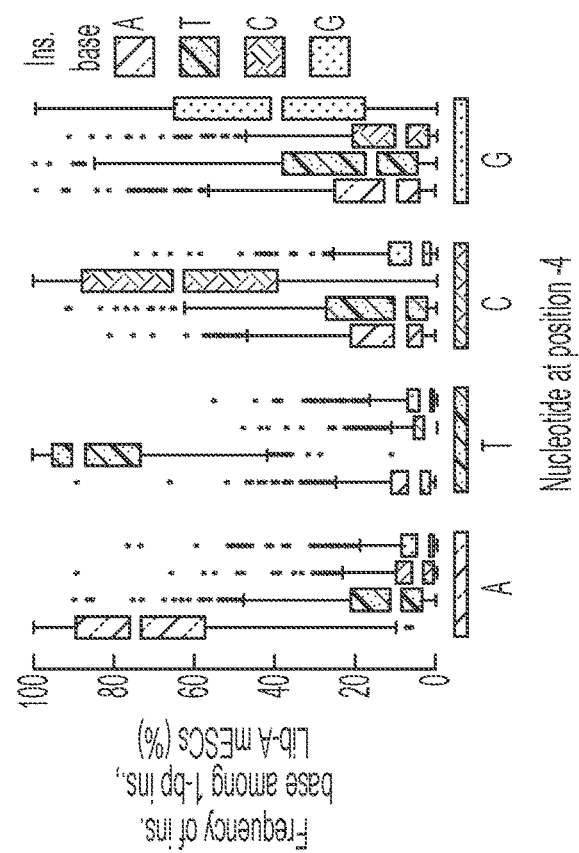
FIG. 20F

| Pathogenic 1-bp deletion genotype (hg19) | Observed frequency of 1-bp insertions in all edited products (%) | Observed frequency of repair to wild-type frame in all edited products (%) | Observed frequency of repair to wild-type genotype in all edited products (%) | Observed frequency of repair to wild-type amino acid sequence all edited products (%) |
| --- | --- | --- | --- | --- |
| KLHL7 chr7:23205401 | 33 | 55 | 33 | 33 |
| NF2 chr22:30038270 | 17 | 60 | 1* | 17 |
| NBN chr8:90995063 | 19 | 30 | 17 | 18 |
| PAX2 chr10:102541067 | 12 | 29 | 0* | 11 |
| LDLR chr19:11231158 | 19 | 49 | 13 | 13 |
| MAN2B1 chr19:12767768 | 20 | 50 | 13 | 13 |
| MLPH chr2:238436125 | 22 | 48 | 0* | 22 |
| SH3BP2 chr4:2824671 | 26 | 49 | 2* | 26 |
| COL4A4 chr2:227942769 | 16 | 49 | 16 | 16 |
| NIPBL chr5:36961683 | 28 | 51 | 0* | 28 |
| UGT1A4 chr2:234627639 | 18 | 55 | 17 | 17 |
| MFRP chr11:119216271 | 9 | 42 | 2* | 2 |

FIG. 23G

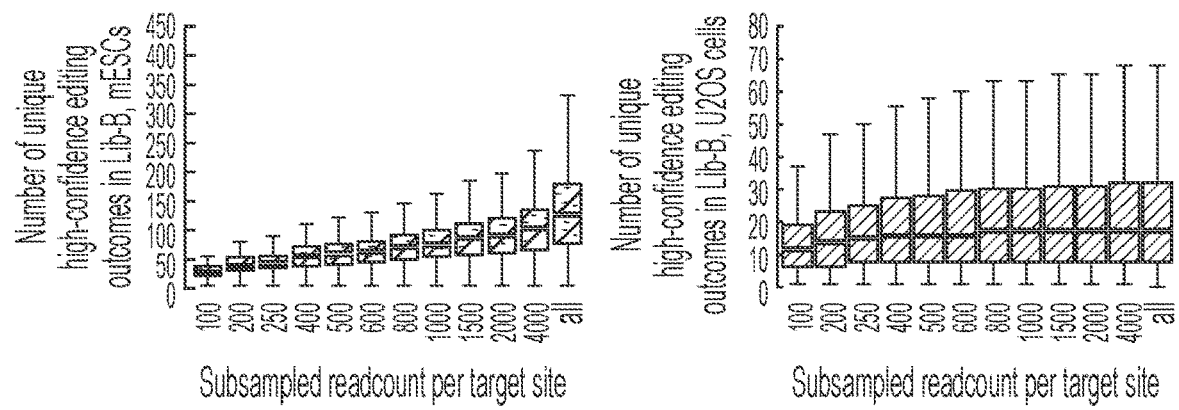
FIG. 25A
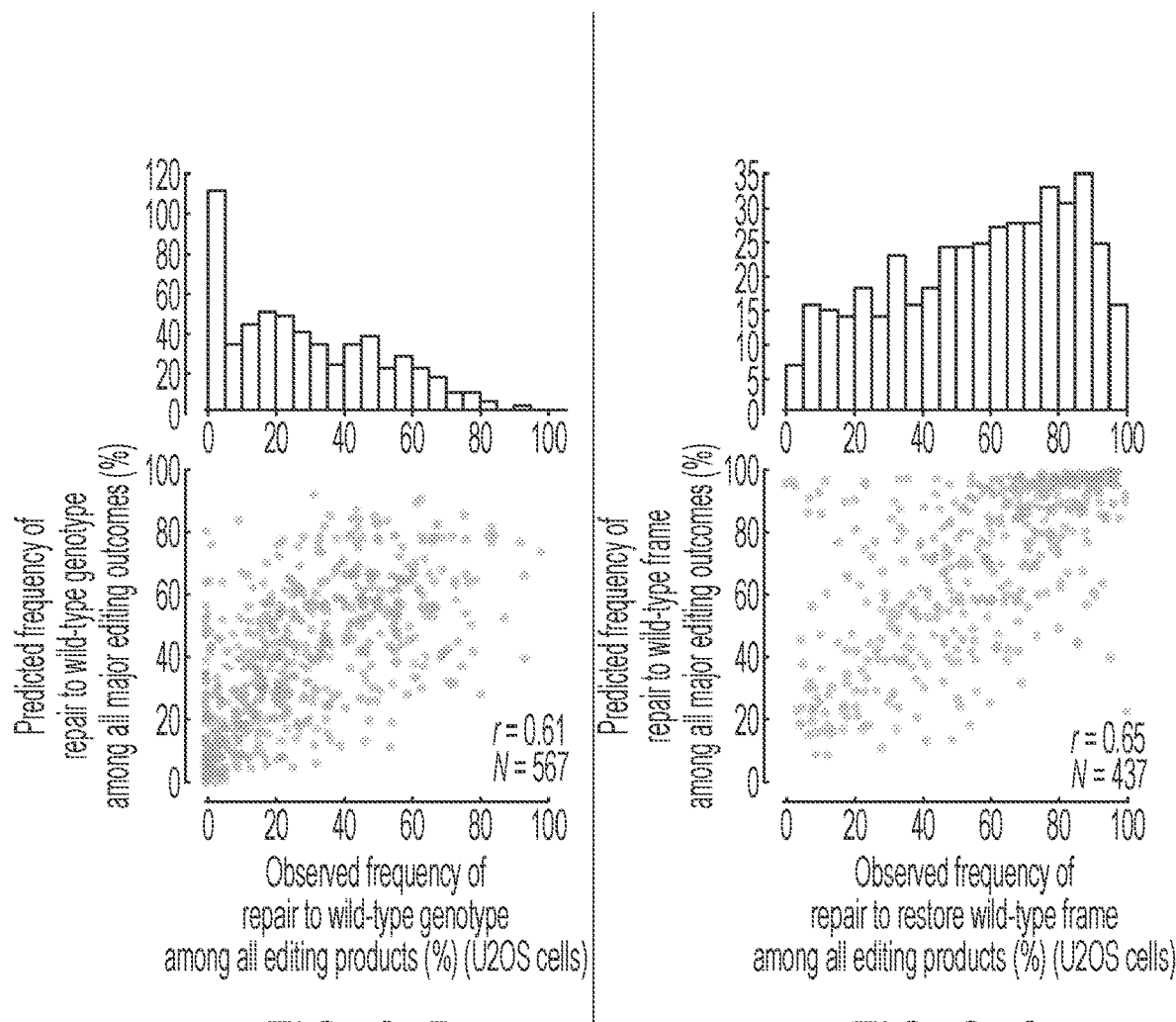
FIG. 25B
FIG. 25C

| Prkdc-/-Lig4-/- | MLN4924 | DPKi3 | NU7026 |
|---|---|---|---|
| Prkdc-/-Lig4-/- | - | | | |
| MLN4924 | 0.09 | | 0.16 | 0.18 |
| DPKi3 | - | | 0.77 | 0.73 |
| NU7026 | - | | - | 0.81 |

FIG. 26E

SYSTEMS AND METHODS FOR PREDICTING REPAIR OUTCOMES IN GENETIC ENGINEERING

GOVERNMENT SUPPORT

This invention was made with government support under HG008754, EB022376, GM118062, HG009490, and DK101684 awarded by the National Institutes of Health, and HR0011-17-2-0049 awarded by the Defense Advanced Research Projects Agency. The government has certain rights in the invention.

REFERENCE TO AN ELECTRONIC SEQUENCE LISTING

The contents of the electronic sequence listing (B119570051US01-SUBSEQ-ARM.txt; Size: 2,771,180 bytes; and Date of Creation: Nov. 7, 2023) is herein incorporated by reference in its entirety.

RELATED APPLICATIONS

This application is a national stage filing under 35 U.S.C. § 371 of international PCT application, PCT/US2018/065886, filed Dec. 15, 2018, which claims priority under 35 U.S.C. § 119(e) to U.S. Provisional Patent Application, U.S. Ser. No. 62/599,623, filed on Dec. 15, 2017, and to U.S. Provisional Patent Application, U.S. Ser. No. 62/669,771, filed May 10, 2018, each of which is incorporated herein by reference.

BACKGROUND OF THE INVENTION

CRISPR (clustered regularly interspaced short palindromic repeats)-Cas9 has revolutionized genome editing, providing powerful research tools and promising agents for the potential treatment of genetic diseases[1-3]. The DNA-targeting capabilities of Cas9 have been improved by the development of gRNA design principles[4], modeling of factors leading to off-target DNA cleavage, enhancement of Cas9 sequence fidelity by modifications to the nuclease[5,6] and gRNA[7], and the evolution or engineering of Cas9 variants with alternative PAM sequences[8-10]. Similarly, control over the product distribution of genome editing has been advanced by the development of base editing to achieve precise and efficient single-nucleotide mutations[7,11,12], and the improvement of template-directed homology-directed repair (HDR) of double strand breaks[13-15].

Non-template directed repair systems, including non-homologous end-joining (NHEJ) and microhomology-mediated end-joining (MMEJ), are major pathways involved in the repair of Cas9-mediated double-strand breaks that can result in highly heterogeneous repair outcomes that generate hundreds of genotypes following DNA cleavage at a single site. While end-joining repair of Cas9-mediated double-stranded DNA breaks has been harnessed to facilitate knock-in of DNA templates[18-21] or deletion of intervening sequence between two cleavage sites[22], NHEJ and MMEJ are not generally considered useful for precision genome editing applications. Recent work has found that the heterogeneous distribution of Cas9-mediated editing products at a given target site is reproducible and dependent on local sequence context[20,21], but no general methods have been described to predict genotypic products following Cas9-induced double-stranded DNA breaks.

The generally accepted view is that DNA double-strand break repair (i.e., template-free, non-homology-dependent repair) following cleavage by genome editing systems produces stochastic and heterogenous repair products and is therefore impractical for applications beyond gene disruption. Further, template-free repair processes (e.g., MMEJ and NHEJ) following DNA double-strand break, despite being more efficient than homology-based repair, are generally not viewed as feasible solutions to precision repair applications, such as restoring the function of a defective gene with a gain-of-function genetic change. Accordingly, methods and solutions enabling the judicious application of template-free genome editing systems, including CRISPR/Cas, TALEN, or Zinc-Finger genome editing systems, would significantly advance the field of genome editing.

SUMMARY OF THE INVENTION

The present inventors have unexpectedly found through computational analyses that template-free DNA/genome editing systems, e.g., CRISPR/Cas9, Cas-based, Cpf1-based, or other DSB (double-strand break)-based genome editing systems, produce a predictable set of repair genotypes thereby enabling the use of such editing systems for applications involving or requiring precise manipulation of DNA, e.g., the correction of a disease-causing genetic mutation or modifying a wildtype sequence to confer a genetic advantage. This finding is contrary to the accepted view that DNA double-strand break repair (i.e., template-free, non-homology-dependent repair) following cleavage by genome editing systems produces stochastic and heterogenous repair products and are therefore impractical for applications beyond gene disruption. Thus, the specification describes and discloses in various aspects and embodiments computational-based methods and systems for practically harnessing the innate efficiencies of template-free DNA repair systems for carrying out precise DNA and/or genomic editing without the reliance upon homology-based repair.

Accordingly, the specification provides in one aspect a method of introducing a desired genetic change in a nucleotide sequence using a double-strand brake (DSB)-inducing genome editing system, the method comprising: identifying one or more available cut sites in a nucleotide sequence; analyzing the nucleotide sequence and available cut sites with a computational model to identify the optimal cut site for introducing the desired genetic change into the nucleotide sequence; and contacting the nucleotide sequence with a DSB-inducing genome editing system, thereby introducing the desired genetic change in the nucleotide sequence at the cut site.

In another aspect, the specification provides a method of treating a genetic disease by correcting a disease-causing mutation using a double-strand brake (DSB)-inducing genome editing system, the method comprising: identifying one or more available cut sites in a nucleotide sequence comprising a disease-causing mutation; analyzing the nucleotide sequence and available cut sites with a computational model to identify the optimal cut site for correcting the disease-causing mutation in the nucleotide sequence; and contacting the nucleotide sequence with a DSB-inducing genome editing system, thereby correcting the disease-causing mutation and treating the disease.

In yet another aspect, the specification provides a method of altering a genetic trait by introducing a genetic change in a nucleotide sequence using a double-strand brake (DSB)-inducing genome editing system, the method comprising: identifying one or more available cut sites in a nucleotide sequence; analyzing the nucleotide sequence and available cut sites with a computational model to identify the optimal cut site for introducing the genetic change into the nucleotide sequence; and contacting the nucleotide sequence with a DSB-inducing genome editing system, thereby introducing the desired genetic change in the nucleotide sequence at the cut site and consequently altering the associated genetic trait.

In another aspect, the specification provides a method of selecting a guide RNA for use in a Cas-genome editing system capable of introducing a genetic change into a nucleotide sequence of a target genomic location, the method comprising: identifying in a nucleotide sequence of a target genomic location one or more available cut sites for a Cas-based genome editing system; and analyzing the nucleotide sequence and cut site with a computational model to identify a guide RNA capable of introducing the genetic change into the nucleotide sequence of the target genomic location.

In still another aspect, the specification provides a method of introducing a genetic change in the genome of a cell with a Cas-based genome editing system comprising: selecting a guide RNA for use in the Cas-based genome editing system in accordance with the method of the above aspect; and contacting the genome of the cell with the guide RNA and the Cas-based genome editing system, thereby introducing the genetic change.

In various embodiments, the cut sites available in the nucleotide sequence are a function of the particular DSB-inducing genome editing system in use, e.g., a Cas-based genome editing system.

In certain embodiments, the nucleotide sequence is a genome of a cell.

In certain other embodiments, the method for introducing the desired genetic change is done in vivo within a cell or an organism (e.g., a mammal), or ex vivo within a cell isolated or separated from an organism (e.g., an isolated mammalian cancer cell), or in vitro on an isolated nucleotide sequence outside the context of a cell.

In various embodiments, the DSB-inducing genome editing system can be a Cas-based genoe editing system, e.g., a type II Cas-based genome editing system. In other embodiments, the DSB-inducing genome editing system can be a TALENS-based editing system or a Zinc-Finger-based genome editing system. In still other embodiments, the DSB-inducing genome editing system can be any such endonuclease-based system which catalyzes the formation of a double-strand break at a specific one or more cut sites.

In embodiments involving a Cas-based genome editing system, the method can further comprise selecting a cognate guide RNA capable of directing a double-strand break at the optimal cut site by the Cas-based genome editing system.

In certain embodiments, the guide RNA is selected from the group consisting the guide RNA sequences listed in any of Tables 1-6. In various embodiments, the guide RNA can be known or can be newly designed.

In various embodiments, the double-strand brake (DSB)-inducing genome editing system is capable of editing the genome without homology-directed repair.

In other embodiments, the double-strand brake (DSB)-inducing genome editing system comprises a type I Cas RNA-guided endonuclease, or a variant or orthologue thereof.

In still other embodiments, the double-strand brake (DSB)-inducing genome editing system comprises a type II Cas RNA-guided endonuclease, or a functional variant or orthologue thereof.

The double-strand brake (DSB)-inducing genome editing system may comprise a Cas9 RNA-guided endonuclease, or a variant or orthologue thereof in certain embodiments.

In still other embodiments, the double-strand brake (DSB)-inducing genome editing system can comprise a Cpf1 RNA-guided endonuclease, or a variant or orthologue thereof.

In yet further embodiments, the double-strand brake (DSB)-inducing genome editing system can comprise a *Streptococcus pyogenes* Cas9 (SpCas9), *Staphylococcus pyogenes* Cas9 (SpCas9), *Staphyloccocus aureus* Cas (Sa-Cas9), *Francisella novicida* Cas9 (FnCas9), or a functional variant or orthologue thereof.

In various embodiments, the desired genetic change to be introduced into the nucleotide sequence, e.g., a genome, is to a correction to a genetic mutation. In embodiments, the genetic mutation is a single-nucleotide polymorphism, a deletion mutation, an insertion mutation, or a microduplication error.

In still other embodiments, the genetic change can comprises a 2-60-bp deletion or a 1-bp insertion.

The genetic change in other embodiments can comprise a deletion of between 2-20, or 4-40, or 8-80, or 16-160, or 32-320, 64-640, or up to 1000, 2000, 3000, 4000, 5000, 6000, 7000, 8000, 9000, or 10,000 or more nucleotides. Preferably, the deletion can restore the function of a defective gene, e.g., a gain-of-function frameshift genetic change.

In other embodiments, the desired genetic change is a desired modification to a wildtype gene that confers and/or alters one or more traits, e.g., conferring increased resistance to a pathogen or altering a monogenic trait (e.g., eye color) or polygenic trait (e.g., height or weight).

In embodiments involving correcting a disease-causing mutation, the disease can be a monogenic disease. Such monogenic diseases can include, for example, sickle cell disease, cystic fibrosis, polycystic kidney disease, Tay-Sachs disease, achondroplasia, beta-thalassemia, Hurler syndrome, severe combined immunodeficiency, hemophilia, glycogen storage disease Ia, and Duchenne muscular dystrophy.

In any of the above aspects and embodiments, the step of identifying the available cut sites can involve identifying one or more PAM sequences in the case of a Cas-based genome editing system.

In various embodiments of the above methods, the computational model used to analyze the nucleotide sequence is a deep learning computational model, or a neural network model having one or more hidden layers. In various embodiments, the computational model is trained with experimental data to predict the probability of distribution of indel lengths for any given nucleotide sequence and cut site. In still other embodiments, the computational model is trained with experimental data to predict the probability of distribution of genotype frequencies for any given nucleotide sequence and cut site.

In various embodiments, the computational model comprises one or more training modules for evaluating experimental data.

In various embodiments, the computational model can comprise: a first training module for computing a microhomology score matrix; a second training module for computing a microhomology independent score matrix; and a third training module for computing a probability distribution over 1-bp insertions, wherein once trained with experimental data the computational model computes a probability distribution over indel genotypes and a probability distribution over indel lengths for any given input nucleotide sequence and cut site.

In other embodiments, the computational model predicts genomic repair outcomes for any given input nucleotide sequence and cut site.

In various embodiments, the genomic repair outcomes can comprise microhomology deletions, microhomology-less deletions, and/or 1-bp insertions.

In still other embodiments, the computational model can comprise one or more modules each comprising one more input features selected from the group consisting of: a target site nucleotide sequence; a cut site; a PAM-sequence; microhomology lengths relative at a cut site, % GC content at a cut site; and microhomology deletion lengths at a cut site, and type of DSB-genome editing system.

In various embodiments, the nucleotide sequence analyzed by the computational model is between about 25-100 nucleotides, 50-200 nucleotides, 100-400 nucleotides, 200-800 nucleotides, 400-1600 nucleotides, 800-3200 nucleotides, and 1600-6400 nucleotide, or even up to 7K, 8K, 9K, 10K, 11K, 12K, 13K, 14K, 15K, 16K, 17K, 18K, 19K, 20K nucleotides, or more in length.

In another aspect, the specification relates to guide RNAs which are identified by various methods described herein. In certain embodiments, the guide RNAs can be any of those presented in Tables 1-6, the contents of which form part of this specification.

According to various embodiments, the RNA can be purely ribonucleic acid molecules. However, in other embodiments, the RNA guides can comprise one or more naturally-occurring or non-naturally occurring modifications. In various embodiments, the modifications can including, but are not limited to, nucleoside analogs, chemically modified bases, intercalated bases, modified sugars, and modified phosphate group linkers. In certain embodiments, the guide RNAs can comprise one or more phosphorothioate and/or 5'-N-phosphporamidite linkages.

In still other aspects, the specification discloses vectors comprising one or more nucleotide sequences disclosed herein, e.g., vectors encoding one or more guide RNAs, one or more target nucleotide sequences which are being edited, or a combination thereof. The vectors may comprise naturally occurring sequences, or non-naturally occurring sequences, or a combination thereof.

In still other aspects, the specification discloses host cells comprising the herein disclosed vectors encoding one more more nucleotide sequences embodied herein, e.g., one or more guide RNAs, one or more target nucleotide sequences which are being edited, or a combination thereof.

In other aspects, the specification discloses a Cas-based genome editing system comprising a Cas protein (or homolog, variant, or orthologue thereof) complexed with at least one guide RNA. In certain embodiments, the guide RNA can be any of those disclosed in Tables 1-6, or a functional variant thereof.

In still other aspects, the specification provides a Cas-based genome editing system comprising an expression vector having at least one expressible nucleotide sequence encoding a Cas protein (or homolog, variant, or orthologue thereof) and at least one other expressible nucleotide sequence encoding a guide RNA, wherein the guide RNA can be identified by the methods disclosed herein for selecting a guide RNA.

In yet another aspect, the specification provides a Cas-based genome editing system comprising an expression vector having at least one expressible nucleotide sequence encoding a Cas protein (or homolog, variant, or orthologue thereof) and at least one other expressible nucleotide sequence encoding a guide RNA, wherein the guide RNA can be identified by the methods disclosed herein for selecting a guide RNA.

In still a further aspect, the specification provides a library for training a computational model for selecting a guide RNA sequence for use with a Cas-based genome editing system capable of introducing a genetic change into a genome without homology-directed repair, wherein the library comprises a plurality of vectors each comprising a first nucleotide sequence of a target genomic location having a cut site and a second nucleotide sequence encoding a cognate guide RNA capable of directing a Cas-based genome editing system to carry out a double-strand break at the cut site of the first nucleotide sequence.

In another aspect, the specification provides a library and its use for training a computational model for selecting an optimized cut site for use with a DSB-based genome editing system (e.g., Cas-based system, TALAN-based system, or a Zinc-Finger-based system) that is capable of introducing a desired genetic change into a nucleotide sequence (e.g., a genome) at the selected cut site without homology-directed repair, wherein the library comprises a plurality of vectors each comprising a nucleotide sequence having a cut site, and optionally a second nucleotide sequence encoding a cognate guide RNA (in embodiments involving a Cas-based genome editing system).

In a still further aspect, the specification discloses a computational model.

In certain embodiments, the computational model can predict and/or compute an optimized or preferred cut site for a DSB-based genome editing system for introducing a genetic change into a nucleotide sequence. In preferred embodiments, the repair does not require homology-based repair mechanisms.

In certain other embodiments, the computational model can predict and/or compute an optimized or preferred cut site for a Cas-based genome editing system for introducing a genetic change into a nucleotide sequence. In preferred embodiments, the repair does not require homology-based repair mechanisms.

In still other embodiments, the computation model provides for the selection of a optimized or preferred guide RNA for use with a Cas-based genome editing system for introducing a genetic change in a genome. In preferred embodiments, the repair does not require homology-based repair mechanisms.

In various embodiments, the computational model is a neural network model having one or more hidden layers.

In other embodiments, the computational model is a deep learning computational model.

In various embodiments, that the DSB-based genome editing system (e.g., a Cas-based genome editing system) edits the genome without relying on homology-based repair.

In various embodiments, that computational model is trained with experimental data to predict the probability of distribution of indel lengths for any given nucleotide sequence and cut site. In other embodiments, computational model is trained with experimental data to predict the probability of distribution of genotype frequencies for any given nucleotide sequence and cut site.

In embodiments, the computational model comprises one or more training modules for evaluating experimental data.

In an embodiment, the computational model comprises: a first training module (305) for computing a microhomology score matrix (305); a second training module (310) for computing a microhomology independent score matrix; and a third training module (315) for computing a probability distribution over 1-bp insertions, wherein once trained with experimental data the computational model computes a probability distribution over indel genotypes and a probability distribution over indel lengths for any given input nucleotide sequence and cut site.

In certain embodiments, the computational model predicts genomic repair outcomes for any given input nucleotide sequence (i.e., context sequence) and cut site.

In certain embodiments, the genomic repair outcomes comprise microhomology deletions, microhomology-less deletions, and 1-bp insertions.

In various embodiments, the one or more modules each comprising one more input features selected from the group consisting of: a target site nucleotide sequence; a cut site; a PAM-sequence; microhomology lengths relative at a cut site, % GC content at a cut site; and microhomology deletion lengths at a cut site.

In certain embodiments, the nucleotide sequence analyzed by the computational model is between about 25-100 nucleotides, 50-200 nucleotides, 100-400 nucleotides, 200-800 nucleotides, 400-1600 nucleotides, 800-3200 nucleotides, and 1600-6400 nucleotide, or more.

In yet another aspect, the specification discloses a method for training a computational model, comprising: (i) preparing a library comprising a plurality of nucleic acid molecules each encoding a nucleotide target sequence and a cognate guide RNA, wherein each nucleotide target sequence comprises a cut site; (ii) introducing the library into a plurality of host cells; (iii) contacting the library in the host cells with a Cas-based genome editing system to produce a plurality of genomic repair products; (iv) determining the sequences of the genomic repair products; and (iv) training the computational model with input data that comprises at least the sequences of the nucleotide target sequence and/or the genomic repair products and the cut sites.

In still another aspect, the specification discloses a method for training a computational model, comprising: (i) preparing a library comprising a plurality of nucleic acid molecules each encoding a nucleotide target sequence and a cut site; (ii) introducing the library into a plurality of host cells; (iii) contacting the library in the host cells with a DSB-based genome editing system to produce a plurality of genomic repair products; (iv) determining the sequences of the genomic repair products; and (iv) training the computational model with input data that comprises at least the sequences of the nucleotide target sequence and/or the genomic repair products and the cut sites.

In certain embodiments, the trained computational models disclosed herein are capable of computing a probability of distribution of indel lengths for any given input nucleotide sequence and input cut site, and/or a probability of distribution of genotype frequencies for any given input nucleotide sequence and input cut site.

In embodiments relating to Cas-based genomic editing systems, the trained computational model is capable of selecting a guide RNA for use with a Cas-based genome editing system for introducing a genetic change into a genome.

The computational model provides a means to produce precision genetic change with a DSB-based genomic editing system. The genetic changes can include microhomology deletion, microhomology-less deletion, and 1-bp insertion. In certain embodiments, the genetic change corrects a disease-causing mutation. In other embodiments, the genetic change modifies a wildtype sequence, which may confer a change in a genetic trait (e.g., a monogenic or polygenic trait). The disease-causing mutation that can be corrected using the computational model with a DSB-based genomic editing sytem can include, but is not limited to, sickle cell disease, cystic fibrosis, polycystic kidney disease, Tay-Sachs disease, achondroplasia, beta-thalassemia, Hurler syndrome, severe combined immunodeficiency, hemophilia, glycogen storage disease Ia, or Duchenne muscular dystrophy.

In another aspect, the disclosure provides a method for selecting one or more guide RNAs (gRNAs) from a plurality of gRNAs for CRISPR, comprising acts of: for at least one gRNA of the plurality of gRNAs, using a local DNA sequence and a cut site targeted by the at least one gRNA to predict a frequency of one or more repair genotypes resulting from template-free repair following application of CRISPR with the at least one gRNA; and determining whether to select the at least one gRNA based at least in part on the predicted frequency of the one or more repaired genotypes.

In embodiments, the one or more repair genotypes correspond to one or more healthy alleles of a gene related to a disease. In other embodiments, the predicted frequency of the one or more repair genotypes is at least about 30%, or at least about 40%, or at least about 50%, or more.

In certain embodiments, the step of predicting the frequency of the one or more repair genotypes comprises: for each deletion length of a plurality of deletion lengths, aligning subsequences of that deletion length on 5' and 3' sides of the cut site to identify one or more longest microhomologies; featurizing the identified microhomologies; applying a machine learning model to compute a frequency distribution over the plurality of deletion lengths; and using frequency distribution over the plurality of deletion lengths to determine the frequency of the one or more repair genotypes.

In certain embodiments, the plurality of gRNAs comprise gRNAs for CRISPR/Cas9, and the application of CRISPR comprises application of CRISPR/Cas9.

In yet another aspect, the system comprises: at least one processor; and at least one computer-readable storage medium having encoded thereon instructions which, when executed, cause the at least one processor to perform a herein disclosed computational method.

A method for editing a nucleotide sequence using a DSB-based genomic editing system that introduces a genetic change at a cut site in a nucleotide sequence, wherein the cut site location is informed by a computational model that computes a frequency distribution over the plurality of deletion lengths and/or a frequency distribution of one or more repaired genotypes over the deletion lengths.

BRIEF DESCRIPTION OF THE DRAWINGS

FIG. 1 shows an illustrative DNA segment 100, in accordance with some embodiments.

FIGS. 2A-D show an illustrative matching of 3' ends of top and bottom strands of a DNA segment at a cut site and an illustrative repair product, in accordance with some embodiments.

FIG. 3B shows an illustrative process 350 for building one or more machine learning models for predicting frequencies of deletion genotypes and/or deletion lengths, in accordance with some embodiments.

FIG. 7 shows illustrative examples of a blunt-end cut and a staggered cut, in accordance with some embodiments.

FIG. 8D shows a microhomology identified in the example of FIG. 8C, in accordance with some embodiments.

FIG. 11A, A genome-integrated screening library approach for monitoring Cas9 editing products at thousands of target sequences. FIG. 11B, Frequency of Cas9-mediated repair products by class from 1,996 Lib-A target sequences in mouse embryonic stem cells (mESCs).

FIG. 11C, Distribution of Cas9-mediated repair products by class in 88 VO target sequences in K562 cells.

FIG. 12A, Schematic of computational flow for inDelphi modeling. inDelphi separates Cas9-mediated editing products by indel type and uses machine learning tools trained on experimental Lib-A editing products to predict relative frequencies of editing products for any target site. Major editing products include 1-to 60-bp MH deletions, 1-to 60-bp MH-less deletions, and 1-bp insertions. FIG. 12B, Mechanism depicting microhomology-mediated end-joining repair, which yields distinct repair outcomes that reflect which microhomologous bases are used during repair.

FIG. 12C, Observed mean frequency of 1-bp insertion genotypes among 1,981 Lib-A target sequences with varying $-4$ nucleotides. Error bars show 95% C.I. on sample mean with 1000-fold bootstrapping. Data distributions are shown in FIGS. 18A-18H. FIG. 12D, Comparison of observed 1-bp insertion frequencies among all Cas9-edited products from 1,996 Lib-A target sequences. The box denotes the 25th, 50th, and 75th percentiles, whiskers show 1.5 times the interquartile range, and outliers are depicted as fliers. *$P=5.4\times10-36$; **$P=8.6\times10-70$, two-sided two-sample T-test, test statistic=$-13.0$ and $-18.4$, degrees of freedom=777 and 1,994; Hedges' g effect size=0.94 and 0.85, for*and**respectively. FIG. 12E, Motif representation of base identities that impact the frequency of 1-bp insertions in Lib-A data. Only bases with non-zero linear regression weights in 10,000-fold iterative cross-validation are shown. Median held-out Pearson correlation 0.62, total N=1996.

FIG. 13A, Histogram of the observed fraction of Cas9-mediated editing products whose indel length is included in inDelphi predictions in endogenous VO target sequences in HEK293 (N=86), HCT116 (N=91), and K562 (N=82) cells. FIG. 13B, Distribution of Pearson correlation values comparing inDelphi predictions to observed product frequencies in VO sequence contexts in HEK293T (N=86), HCT116 (N=91), and K562 (N=82) cells. The box denotes the 25th, 50th, and 75th percentiles, and whiskers show 1.5 times the interquartile range.

FIG. 13C, Distribution of Pearson correlation values comparing inDelphi predictions to observed indel length frequencies in VO sequence contexts in HEK293 (N=86), HCT116 (N=91), and K562 (N=82) cells. Box plot as in (FIG. 13B). FIG. 13D, Comparison of inDelphi and Microhomology-Predictor frameshift predictions to observed frameshift frequencies among 86 VO target sequences in HEK293 cells. The error band represents the 95% C.I. around the regression estimate with 1,000-fold bootstrapping. FIG. 13E shows 1-bp insertion frequencies among edited outcomes in U2OS and HEK293T cells (n=27 and 26 observations, baseline n=1,958 and 89 target sites, $P=4.2\times10-8$ and $8.1\times10-12$, respectively), two-sided Welch's t-test. FIG. 13F shows smoothed predicted distribution of the highest frequency indel among major editing outcomes (+1 to $-60$ indels) for SpCas9 gRNAs targeting the human genome.

FIG. 14A, Schematic of deletion repair at a designed Lib-B target sequence with a 9-bp microduplication and strong sequence microhomology. FIG. 14B, Observed frequency of microduplication collapse among all edited products at 56 Lib-B target sequences designed with 7- to 25-bp microduplications. The error band represents the 95% C.I. around the regression estimate with 1,000-fold bootstrapping. FIG. 14C, Observed frequencies of 1-bp insertions among 205 sequence contexts designed to vary base identity at positions $-5$ to $-2$ (relative to the PAM at positions 0-2) in three surrounding low-microhomology sequence contexts. The X-axis is sorted by median 1-bp insertion frequency; see FIGS. 20A-20E for the complete axis. FIG. 14D, Comparison of the observed 1-bp insertion frequency at 205 Lib-B designed sequences as in (FIG. 14C) with varying positions $-4$ and $-3$. The box denotes the 25th, 50th, and 75th percentiles, whiskers show 1.5 times the interquartile range, and outliers are depicted as fliers. *$P=0.03$; **$P=2.98\times10-7$, two-sided two-sample T-test, test statistic=$-2.2$ and $-6.5$, degrees of freedom=185 and 32, Hedges' g effect size=0.58 and 2.3, for*and**respectively. FIG. 14E, Comparison of predicted precision scores to observed precision scores for microhomology deletions in 86 VO target sites in HEK293 cells. FIG. 14F, Distribution of the predicted frequency of the most frequent deletion and insertion outcomes among major editing outcomes (1-bp insertions, 1- to 60-bp MH deletions, and 1- to 60-bp MH-less deletions) at 1,063,802 Cas9 gRNAs targeting human exons and introns.

FIG. 15A, Using Cas9-nuclease to correct a pathogenic LDLR allele to wild-type. FIG. 15B, Comparison among ClinVar/HGMD pathogenic alleles of observed and predicted frequencies of repair to wild-type alleles, accompanied by a histogram of observed frequencies. Major editing products include 1-bp insertions, 1- to 60-bp MH deletions, and 1- to 60-bp MH-less deletions. FIG. 15C, Comparison of observed and predicted frequencies of frameshift repair to the wild-type frame among ClinVar/HGMD pathogenic alleles, accompanied by a histogram of observed frequencies. Major editing products are defined as in (FIB. 15B).

FIG. 15D, Histograms of observed frequencies of repair to the wild-type genotype for wild-type mESCs and Prdkc-/-Lig4-/- mESCs at Lib-B pathogenic microduplication alleles with predicted repair frequency ≥50% among all major editing products, defined as in (FIG. 15B). Dashed lines indicate sample means which differ significantly. P=7.8×10-12; two-sided two-sample T-test, test statistic=-6.9, degrees of freedom=1,297, Hedges' g effect size=0.39. FIG. 15E, Flow cytometry contour plots showing GFP fluorescence and LDL-DyLight550 uptake in mESCs containing the LDLRdup1662_1669dupGCTGGTGA-P2A-GFP allele (LDLRdup-P2A-GFP) and treated with SpCas9 and gRNA when denoted. FIG. 15F, Fluorescence microscopy of mESCs containing the LDLRdup1662_1669dupGCTGGTGA-P2A-GFP allele treated with SpCas9 and gRNA, or untreated.

FIGS. 16A-16F show design and cloning of a high-throughput library to assess CRISPR-Cas9-mediated editing products. FIG. 16A, From left to right, distributions of predicted Cas9 on-target efficiency (Azimuth score), number of nucleotides participating in microhomology in 3-30-bp deletions, GC content, and estimated precision of deletion outcomes derived from 169,279 potential SpCas9 gRNA target sites in the human genome with quintiles marked as used to design Lib-A. FIG. 16B, Schematic of the cloning process used to clone Lib-A and Lib-B. The cloning process involves ordering a library of oligonucleotides pairing a gRNA protospacer with its 55-bp target sequence, centered on an NGG PAM. To insert the gRNA hairpin between the gRNA protospacer and the target site, the library undergoes an intermediate Gibson Assembly circularization step, restriction enzyme linearization, and Gibson Assembly into a plasmid backbone containing a U6-promoter to facilitate gRNA expression, a hygromycin resistance cassette, and flanking Tol2 transposon sites to facilitate integration into the genome. FIG. 16C, Analysis of cumulative percentage of all CRISPR-Cas9-mediated deletions from VO target sequences in HEK293 (N=89), HCT116 (N=92), and K562 (N=86) that delete up to the reported number of nucleotides (X-axis). 94% of deletions are 30-bp or shorter. FIG. 16D shows the number of unique high-confidence editing outcomes called by simulating data subsampling in data in lib-A (n=2,000 target sites) in mESCs (combined data from n=3 independent biological replicates) and U2OS cells (combined data from n=2 independent biological replicates). For 'all', the original non-subsampled data are presented. Each box depicts data for 2,000 target sites. Outliers are not depicted. FIG. 16E shows Pearson's r of genotype frequencies comparing lib-A in mESCs and U2OS cells with endogenous data in HEK293 (n=87 target sites), HCT116 (n=88), and K562 (n=86) cells. Outliers are depicted as diamonds. 1-bp insertion frequency adjustment was performed at each target site by proportionally scaling them to be equal between two cell types. FIG. 16F shows Pearson's r of genotype frequencies at lib-A target sites, comparing two independent biological replicate experiments in mESCs (n=1,861 target sites, median r=0.89) and U2OS cells (n=1, 921, median r=0.77). Outliers are depicted as diamonds. Box plots denote the 25th, 50th and 75th percentiles and whiskers show 1.5 times the interquartile range.

FIGS. 17A-17D show that high-throughput CRISPR-Cas9 editing outcome screening yields replicate-consistent data that is concordant with the repair spectrum at endogenous human genomic loci. FIG. 17A, Box and swarm plot of the Pearson correlation of the genotypic product frequency spectra at VO target sequences comparing Lib-A in mESCs with endogenous data inHEK293 (N=87), HCT116 (N=88), and K562 (N=86). Each dot represents a target sequence, the box denotes the 25th, 50th and 75th percentiles, whiskers show 1.5 times the interquartile range. FIG. 17B, Pearson correlation of the genotypic product frequency spectra at 1,861 Lib-A target sequences comparing two biological replicate experiments in mESCs. Median r=0.89. The box denotes the 25th, 50th and 75th percentiles, whiskers show 1.5 times the interquartile range, and outliers are depicted as fliers. FIG. 17C, Distribution of Cas9-mediated genotypic products by repair category in endogenous data at VO target sequences in K562 (N=88), HCT116 (N=92), and HEK293 (N=89). FIG. 17D, Frequencies of deletions occurring beyond the Cas9 cutsite by distance as measured by the number of bases between the deleted base nearest to the cutsite and the two bases immediately surrounding the cutsite. Cutsite and distances are oriented with the NGG PAM on the positive side. *P<1×105 for the Pearson correlation between a specific deletion frequency distribution and Cas9 editing rates across target sequences (VO-HEK293T N=96, Lib-A mESC N=2000). Box plot as in (FIG. 17A), with outliers beyond whiskers not depicted.

FIG. 18A, Diagram of all unique alignment outcomes at an example 7-bp deletion accompanied with a table of their MH-less end-joining type, MH length, deletion length, and delta-position. FIG. 18B, Plot of function learned by the neural network modeling MH deletions (MH-NN) mapping MH length and % GC to a numeric score (psi). FIG. 18C, Plot of function learned by the neural network modeling MH-independent deletions (MHless-NN) mapping deletion length to a numeric score (psi). FIG. 18D, Histogram of MHless-NN phi scores by deletion length, normalized to sum to 1. FIG. 18E, Observed frequency of 1-bp insertion genotypes in 1,981 Lib-A target sequences with varying −4 nucleotides. The box denotes the 25th, 50th and 75th percentiles, whiskers show 1.5 times the interquartile range, and outliers are depicted as fliers. FIG. 18F, Plot showing 1-bp insertion frequency in 1,996 Lib-A target sequences compared to their total phi score. Pearson correlation=−0.084 (P=1.7×10-4). FIG. 18G, Relationship between 1-bp insertion frequency in 1,996 Lib-A target sequences compared to the predicted deletion length precision score. Pearson correlation=0.069 (P=2.1×10-3). FIG. 18H, Diagram of hypothesized repair mechanisms that give rise to the outcome categories used by inDelphi, based on known mechanisms of MMEJ, microhomology-mediated alt-NHEJ and c-NHEJ repair pathways. Microhomology-mediated repair begins with 5'-end resection, allowing overlap of 3'-overhangs. Microhomologous basepairing of the 3'-overhangs temporarily stabilizes the ssDNA ends. In microhomology deletion, non-paired 3'-overhangs are removed and polymerase and ligase fill in and connect the gaps to reconstitute a dsDNA strand. In microhomology-less deletions, one 3'-overhang is ligated to the dsDNA backbone and the opposing strand is removed entirely, giving rise to a unilateral deletion with loss of bases on one side of the cutsite only. DNA polymerase and ligation bridge the ssDNA to create a contiguous dsDNA strand. Microhomology-independent mutations occur as a combined result of exonuclease, polymerase, and ligase activity that results in the joining of modified ends at the double strand break cutsite, giving rise to microhomology-less deletions, insertions, and mixtures thereof. FIG. 18I shows the categories of Cas9-mediated genotypic outcomes in data from U2OS cells (n=1,958 lib-A target sites), which can be compared to the categories of Cas9-mediated genotypic outcomes shown in FIG. 17C with regard to data from endogenous contexts at VO target sites in K562 (n=88 target sites), HCT116 (n=92), HEK293 (n=89) cells.

FIG. 19A, Box and swarm plot of the Pearson correlation at 189 held-out Lib-A target sequences comparing inDelphi predictions with observed mESC Lib-A genotype product frequencies. The box denotes the 25th, 50th and 75th percentiles, whiskers show 1.5 times the interquartile range. FIG. 19B, Box and swarm plot of the Pearson correlation at 189 held-out Lib-A target sequences comparing inDelphi predictions with observed mESC Lib-A indel length frequencies for 1-bp insertions to 60-bp deletions. Box plot as in (FIG. 19A). FIG. 19C, Distribution of predicted frameshift frequencies among 1-60-bp deletions for SpCas9 gRNAs targeting exons, shuffled exons, and introns in the human genome. Dashed lines indicate means. ***$P<10-100$. FIG. 19D, Pie chart depicting the output of Delphi for specific outcome classes. MH deletions (58% of all products) and single-base insertions (9% of all products) are predicted at single-base resolution, and deletion length is predicted for MH-less deletions (25% of all products). FIGS. 19E and 19F show a comparison of two methods for frameshift predictions to observed values with Pearson's r in HCT116 cells (FIG. 19E, n=91 target sites) and K562 cells (FIG. 19F, n=82 target sites). The error band represents the 95% confidence intervals around the regression estimate with 1,000-fold bootstrapping.

FIGS. 20A-20K show target sequences with extremely high or low microhomology phi scores skew toward a single predictable Cas9-mediated edited product. FIG. 20A, Scatter plot of the frequency of microduplication repair in Lib-B target sequences with designed 7-25-bp regions of microduplication as a function of microduplication length in human U2OS (N=32) and HEK293T cells (N=39). The Error band represents the 95% C.I. around the regression estimate with 1,000-fold bootstrapping. FIG. 20B, Box plots displaying total deletion phi score, total precision scores, and 1-bp insertion frequencies for (blue) 312 Lib-B sequences in the low-microhomology cohort with four randomized bases flanking the cutsite (fourbp), (green) 89 VO sequences (VO), and (red) 71 Lib-B sequences in the high-microhomology cohort with microduplications ranging from 7-25 bp (longdup). Box displays median and first and third quartiles. Whiskers are at 1.5 times interquartile range (IQR). Either swarm plot or outlier fliers depicted for each box plot. *$P=6.1\times10-9$; two-sided two-sample T-test, test statistic=−5.94, degrees of freedom=399, Hedges' g effect size=0.49. FIG. 20C, Scatterplot of 1-bp insertion frequency among all non-wild-type products when varying four bases surrounding the cutsite (positions −5 to −2 counted from the NGG-PAM at positions 0-2) with all x-tick labels depicted, contained within three target sequences (red, blue, green) from the low-microhomology cohort of Lib-B in mESCs (N=205). FIG. 20D, Distribution of the total frequency of all non-wild-type Cas9 editing products in the subset of target sequences from the low-microhomology cohort containing four randomized bases flanking the cutsite (fourbp) with >50% overall frequencies of 1-bp insertion (N=50), VO sequences (N=89), and the high-microhomology cohort with microduplications ranging from 7-25 bp (longdup) in Lib-B editing in mESCs (N=56). FIG. 20E, Scatterplot displaying 1-bp insertion frequencies and Cas9 editing rate in 205 "fourbp" contexts with Pearson correlation of −0.35 ($P=3.3e-07$). FIG. 20F shows the frequency of 1-bp insertions in mESCs (n=1,981 lib-A target sites) and U2OS cells (n=1,918) with varying −4 nucleotides. FIGS. 20G and 20H show plots of 1-bp insertion frequency in mESCs (n=1,996 lib-A target sites) and U2OS cells (n=1,966) compared to their total phi score (FIG. 20G) and predicted deletion length precision score (FIG. 20H) with Pearson's r. FIG. 20I shows a comparison of 1-bp insertion frequencies among all edited products from 1,966 lib-A target sites in U2OS cells (combined data from n=2 independent biological replicates). FIG. 20J shows nucleotides and their effect on the frequency of 1-bp insertions in U2OS cells. Only bases with non-zero linear regression weights in 10,000-fold iterative cross-validation are shown. Total n=1,966 lib-A target sites. FIG. 20K shows the insertion frequency in mESCs (n=205) and U2OS cells (n=217) when varying four bases by the cleavage site (positions −5 to −2 counted from the NGG-PAM at positions 0-2) contained within three target sites designed with weak microhomology.

FIG. 21A, Observed frequencies of repair to wild-type genotype at 194 ClinVar pathogenic alleles vs. predicted frequencies in Lib-B in human HEK293T cells. FIG. 21B, Observed frequencies of repair to wild-type frame at 140 ClinVar pathogenic alleles vs. predicted frequencies in Lib-B in human HEK293T cells. FIG. 21C, Observed frequencies of repair to wild-type genotype at 49 Clinvar pathogenic alleles vs. predicted frequencies in Lib-B in human U2OS cells. FIG. 21D, Observed frequencies of repair to wild-type frame at 37 ClinVar pathogenic alleles vs. predicted frequencies in Lib-B in human U2OS cells.

FIG. 22A, Distribution of Cas9-mediated genotypic products by repair outcome class in Prkdc−/−Lig4−/− mESC for 1,446 target sequences.

FIG. 22B, Comparison of observed mean frequency of deletion products contributed by microhomology-less unilateral joining and medial joining deletions among all deletions comparing 1,995 Lib-A target sequences in wildtype mESC to 1,850 Lib-A target sequences in Prkdc−/−Lig4−/− mESC. *$P<10-66$; two-sided two-sample T-test, test statistic >17.7, degrees of freedom=3,843; Hedges' g effect size >0.58. FIG. 22C, Comparison of observed frequency of deletion products contributed by microhomology-less unilateral joining and medial joining deletions among all deletions, between 1,995 Lib-A target sequences in wildtype mESC to 1,850 Lib-A target sequences in Prkdc−/−Lig4−/− mESC.*and**as in (FIG. 22B). The box denotes the 25th, 50th and 75th percentiles, whiskers show 1.5 times the interquartile range, and outliers are depicted as fliers. FIG. 22D, Observed mean frequency of 1-bp insertion genotypes at 1,055 target sequences with varying −4 nucleotides in Lib-A in Prkdc−/−Lig4−/− mESCs. The error bars show the 95% C.I. on the sample mean with 1,000-fold bootstrapping. FIG. 22E, Observed frequency of 1-bp insertion genotypes at 1,055 target sequences with varying −4 nucleotides in Lib-A in Prkdc−/−Lig4−/− mESCs. Box plot as in (b).

FIGS. 23A-23H show that template-free Cas9-nuclease editing of human cells containing pathogenic LDLR microduplication alleles restores LDL uptake. FIG. 23A, Flow cytometric contour plots showing GFP fluorescence and LDL-Dylight550 uptake in HCT116 cells containing the denoted LDLR alleles and treated with SaCas9 and gRNA when denoted. FIG. 23B, Fluorescence microscopy of HCT116 cells containing the denoted LDLR alleles and treated with SaCas9 and gRNA when denoted. GFP fluorescence is shown in green, LDL-Dylight550 uptake in red, and Hoechst staining nuclei in blue. FIG. 23C, Fluorescence microscopy of U2OS cells containing the denoted LDLR alleles and treated with SaCas9 and gRNA when denoted. GFP fluorescence is shown in green, LDL-Dylight550 uptake in red, and Hoechst staining nuclei in blue. FIG. 23D, Flow cytometry gating strategy used for mESC+LDLRdup-P2A-GFP untreated. FIG. 23E, Flow cytometry gating strategy used for mESC+LDLRdup-P2A-GFP+SpCas9+gRNA. FIGS. 23F and 23G show the results of 12 pathogenic 1-bp deletion alleles selected by inDelphi for high 1-bp insertion frequency (combined data from n=2 independent biological replicates) compared to lib-A (f) and presented in a table (FIG. 23G). The box denotes the 25th, 50th and 75th percentiles, whiskers show 1.5 times the interquartile range, and outliers are depicted as diamonds. *P=1.6×10-4, two-sided Welch's t-test. For detailed statistics, see Methods. In the table, the most frequent 1-bp insertion genotype predicted by inDelphi that does not correspond to the wild-type genotype is indicated by an asterisk. In fluorescence microscopy plots, GFP fluorescence is shown in green, LDL-Dylight550 uptake in red, and Hoechst staining nuclei in blue. FIG. 23H shows mESC-trained inDelphi genotype prediction accuracy as 40 library sites.

FIG. 25A-25D provides a characterization of lib-B data including pathogenic microduplication repair in wild-type mESCs, wild-type U2OS cells and mESCs treated with DPKi3, NU7026 and MLN4924. FIG. 25A shows box plots of the number of unique high-confidence editing outcomes called by simulating data subsampling in data at 2,000 lib-B target sites in mESCs (combined data from n=2 independent technical replicates) and U2OS cells (combined data from n=2 independent biological replicates). In 'all', the full non-subsampled data are presented (see Table 8 herein for read counts). Each box depicts data for 2,000 target sites. The box denotes the 25th, 50th, and 75th percentiles and whiskers show 1.5 times the interquartile range. Outliers are not depicted. FIG. 25B shows the frequencies of repair to wild-type genotype at 567 ClinVar pathogenic alleles versus predicted frequencies in lib-B in human U2OS cells with Pearson's r. FIG. 25C shows the frequencies of repair to wild-type frame at 437 ClinVar pathogenic alleles versus predicted frequencies in lib-B in human U2OS cells with Pearson's r. FIG. 25D shows the frequency of pathogenic microduplication repair in wild-type mESCs (n=1,480 target sites) compared to mESCs treated with MLN4924 (n=1, 569), NU7041 (n=1,561) and DPKi3 (n=1,563).

FIG. 26A-26G shows the altered distributions of Cas9-mediated genotypic products in Prkdc-/-Lig4-/- mESCs and mESCs treated with DPKi3, NU7026, and MLN4924 compared to wild-type mESCs. FIG. 26A shows a comparison of MH deletions among all deletions at lib-B target sites in wild-type cells (n=1,909 target sites), cells treated with DPKi3 (n=1,999), MLN4924 (n=1,995) or NU7026 (n=1, 999) and Prkdc-/-Lig4-/- cells (n=1,446). Statistical tests performed against wild-type population. *P=5.6×10-5, P=3.5×10-13, *P=5.0×10-41, two-sided Welch's t-test. FIG. 26B shows a comparison of the frequency of each class of MH-less deletions among all deletion products in wild-type (lib-A and lib-B target sites, n=3,829 target sites), DPKi3 (lib-B, n=1,990), MLN4924 (lib-B, n=1,980), NU7026 (lib-B, n=1,992) and Prkdc-/-Lig4-/- (lib-A and lib-B target sites, n=3,344). P values are compared to wild-type, two-sided Welch's t-test. FIG. 26C shows frequency of 1-bp insertions at 1,055 target sites in lib-A in Prkdc-/-Lig4-/- mESCs. FIG. 26D Frequencies of deletion repair to wild-type genotype in lib-B in wild-type mESCs (n=1,480 target sites, combined data from two technical replicates) compared to conditions, with combined data from two independent biological replicates for each of Prkdc-/-Lig4-/- (n=1,041 target sites), MLN4924 (n=1, 569), NU7026 (n=1,561) and DPKi3 (n=1,563). FIG. 26E provides a table of Pearson's r of the change in disease correction frequency compared to wild-type at n=791 target sites for each pair of conditions. f, g, Annexin V-568 staining flow cytometry contour plots (FIG. 26F) and mean±standard deviation values (FIG. 26G) in wild-type and Prkdc-/-Lig4-/- lib-A mESCs following transfection with SpCas9-P2A-GFP (representative data for n=2 experiments). Box plots denote the 25th, 50th and 75th percentiles, whiskers show 1.5 times the interquartile range, and outliers are depicted as diamonds.

DEFINITIONS

Figure 3A:
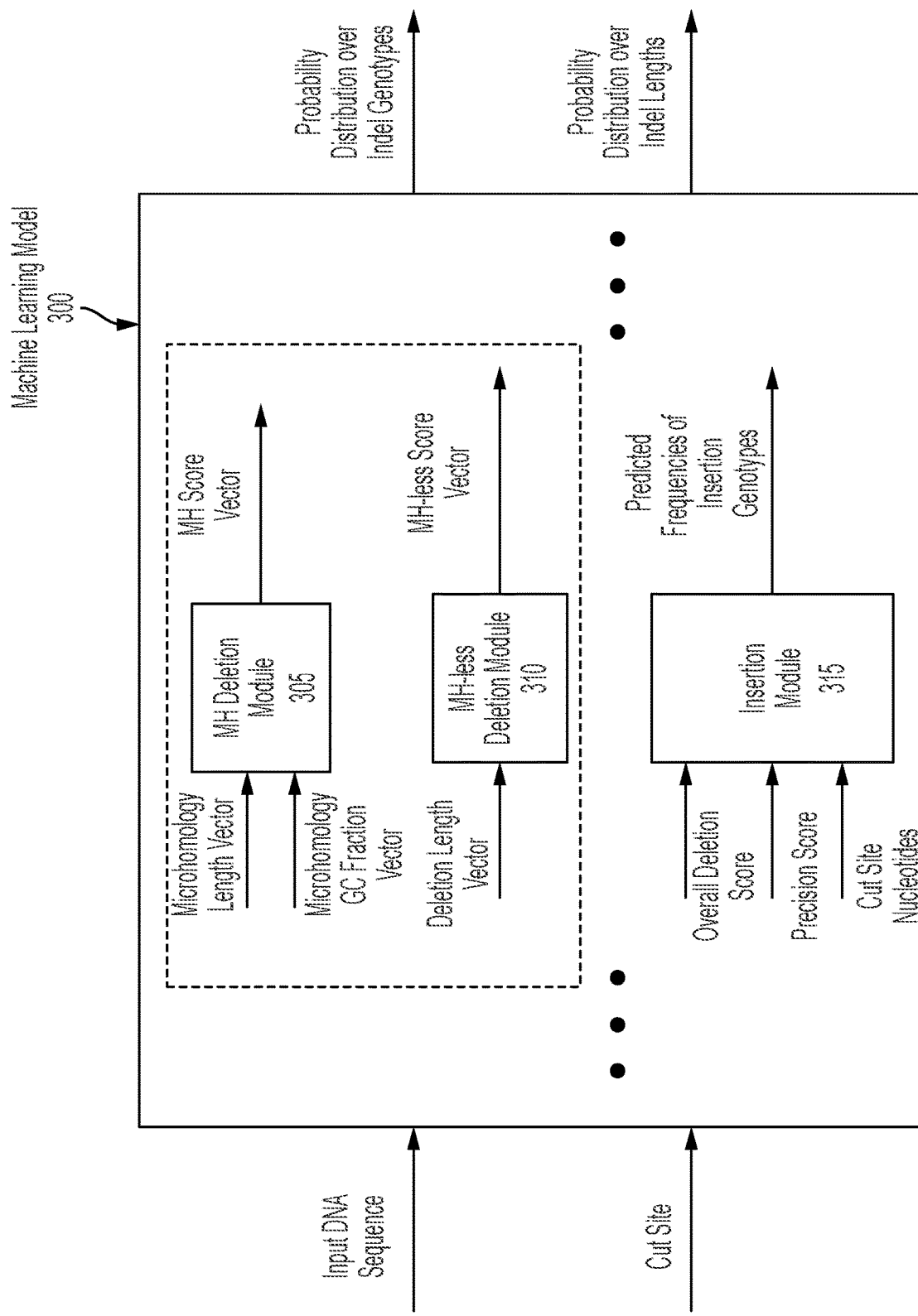
FIG. 3A shows an illustrative machine learning model 300, in accordance with some embodiments.

As used herein and in the claims, the singular forms "a," "an," and "the" include the singular and the plural reference unless the context clearly indicates otherwise. Thus, for example, a reference to "an agent" includes a single agent and a plurality of such agents. The term "Cas9" or "Cas9 nuclease" refers to an RNA-guided nuclease comprising a Cas9 protein, or a fragment thereof (e.g., a protein comprising an active or inactive DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torques* I (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria meningitidis* (NCBI Ref: YP_002342100.1).

The term "Cas-based genome editing system" refers to a system comprising any naturally occurring or variant Cas endonuclease (e.g., Cas9), or functional variant, homolog, or orthologue thereof, and a cognate guide RNA. The term "Cas-based genome editing system" may also refer to an expression vector having at least one expressible nucleotide sequence encoding a Cas protein (or homolog, variant, or orthologue thereof) and at least one other expressible nucleotide sequence encoding a guide RNA.

The term "DSB-based genome editing system" refers to a system comprising any naturally occurring or variant endonuclease which catalyzes the formation of a double strand break at a cut site (e.g., Cas9, Crf1, TALEN, or Zinc Finger), or functional variant, homolog, or orthologue thereof, and a cognate guide RNA if required (e.g., TALENs and Zinc Fingers do not require a guide RNA for targeting to a cut site). The term "DSB-based genome editing system" may also refer to an expression vector having at least one expressible nucleotide sequence encoding a DSB endonuclease protein (or homolog, variant, or orthologue thereof) and at least one other expressible nucleotide sequence encoding a guide RNA, if required (e.g., as required for Cas9 or Crf1).

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a recombinase may refer to the amount of the recombinase that is sufficient to induce recombination at a target site specifically bound and recombined by the recombinase. As will be appreciated by the skilled artisan, the effective amount of an agent, e.g., a nuclease, a recombinase, a hybrid protein, a fusion protein, a protein dimer, a complex of a protein (or protein dimer) and a polynucleotide, or a polynucleotide, may vary depending on various factors as, for example, on the desired biological response, the specific allele, genome, target site, cell, or tissue being targeted, and the agent being used.

The term "linker," as used herein, refers to a chemical group or a molecule linking two molecules or moieties, e.g., a binding domain and a cleavage domain of a nuclease. In some embodiments, a linker joins a gRNA binding domain of an RNA-programmable nuclease and the catalytic domain of a recombinase. In some embodiments, a linker joins a dCas9 and a recombinase. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a recombinase. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeabley to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is homologous to a tracrRNA as depicted in FIG. 1E of Jinek et al., *Science* 337:816-821 (2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. Multiplex genome engineering using CRISPR/Cas systems. *Science* 339, 819-823 (2013); *Mali*, P. et al. RNA-guided human genome engineering via Cas9. *Science* 339, 823-826 (2013); Hwang, W. Y. et al. Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

Use of ordinal terms such as "first," "second," "third," etc. in the claims to modify a claim element does not by itself connote any priority, precedence, or order of one claim element over another or the temporal order in which acts of a method are performed, but are used merely as labels to distinguish one claim element having a certain name from another element having a same name (but for use of the ordinal term) to distinguish the claim elements.

Also, the phraseology and terminology used herein is for the purpose of description and should not be regarded as limiting. The use of "including," "comprising," "having," "containing," "involving," and variations thereof herein, is meant to encompass the items listed thereafter and equivalents thereof as well as additional items.

Detailed Description of Certain Embodiments

Major research efforts focus on improving efficiency and specificity of genome editing systems, such as, CRISPR/Cas9, other Cas-based, TALEN-based, and Zinc Finger-based genome editing systems. For instance, with regard to CRISPR/Cas9 systems, efficiency may be improved by predicting optimal Cas9 guide RNA (gRNA) sequences, while specificity may be improved by modeling factors leading to off-target cutting, and by manipulating Cas9 enzymes. Variant Cas9 enzymes and fusion proteins may be developed to alter the protospacer adjacent motif (PAM) sequences acted on by Cas9, and to produce base-editing Cas9 constructs with high efficiency and specificity. For example, Cpf1 (also known as Cas12a) and other alternatives may be used in CRISPR genome editing in addition to, or instead of, Cas9.

The inventors have recognized and appreciated that less attention has been devoted to understanding and modulating repair outcomes. In that respect, nucleotide insertions and/or deletions resulting from template-free repair mechanisms (e.g., NHEJ, MMEJ, etc. and excluding homology-based repair (HDR)) are commonly thought to be random and therefore only suitable for gene knock-out applications. For gene knock-in or gain-of-function applications, a template-based repair mechanism such as HDR is typically used.

CRISPR/Cas with HDR allows arbitrarily designed DNA sequences to be incorporated at precise genomic locations. However, this technique suffers from low efficiency—HDR occurs rarely in typical biological conditions (e.g., around 10% frequency), because cells only permit HDR to occur after sister chromatids are synthesized in S phase but before M phase when mitosis splits the sister chromatids into daughter cells. For many cell-types, the fraction of time spent in S-G2-M phases of a cell cycle is low. In sum, while outcomes are predictable when HDR does occur, HDR occurs infrequently, and therefore a desired DNA sequence will be incorporated into only a small percentage of cells. In addition, in post-mitotic cell-types of interest such as neurons, the HDR repair pathway is no longer used, further limiting HDR's utility for genetic engineering.

Some research has been done to improve efficiency of HDR, for example, through improved homology templates and small molecule modulation. Despite these efforts, template-based repair efficiency remains low, and proposed CRISPR/Cas gene knock-in or gain of function applications have thus far been limited to ex vivo applications where screening may be performed for cells with a desired repair genotype.

Unlike HDR, NHEJ is capable of occurring during any phase of a cell cycle and in post-mitotic cells. However, NHEJ, as discussed above, has been perceived as a random process that produces a large variety of repair genotypes with insertions and/or deletions, and has been used mainly to knock out genes. In short, NHEJ is efficient but unpredictable.

Recent work suggests that outcomes of some template-free repair mechanisms are actually non-random. For instance, it has been observed that MMEJ is involved in repair outcomes. Furthermore, repair outcomes have been analyzed to predict gRNAs that are more likely to produce frameshifts. However, there is still a need for accurate prediction of genotypic outcomes of CRISPR/Cas cutting and ensuing cellular DNA repair.

The present inventors have unexpectedly found through computational analyses that template-free DNA/genome editing systems, e.g., CRISPR/Cas9, Cas-based, Cpf1-based, or other DSB (double-strand break)-based genome editing systems, produce a predictable set of repair genotypes thereby enabling the use of such editing systems for applications involving or requiring precise manipulation of DNA, e.g., the correction of a disease-causing genetic mutation or modifying a wildtype sequence to confer a genetic advantage. This finding is contrary to the accepted view that DNA double-strand break repair (i.e., template-free, non-homology-dependent repair) following cleavage by genome editing systems produces stochastic and heterogenous repair products and are therefore impractical for applications beyond gene disruption. Thus, the specification describes and discloses in various aspects and embodiments computational-based methods and systems for practically harnessing the innate efficiencies of template-free DNA repair systems for carrying out precise DNA and/or genomic editing without the reliance upon homology-based repair.

In accordance with some embodiments, techniques are provided for predicting genotypes of CRISPR/Cas editing outcomes. For instance, a high-throughput approach may be used for monitoring CRISPR/Cas cutting outcomes, and/or a computer-implemented method may be used to predict genotypic repair outcomes for NHEJ and/or MMEJ. The inventors have recognized and appreciated that accurate prediction of repair genotypes may allow development of CRISPR/Cas gene knock-in or gain-of-function applications based on one or more template-free repair mechanisms. This approach may simplify a genome editing process, by reducing or eliminating a need to introduce exogenous DNA into a cell as a template.

Additionally, or alternatively, using one or more template-free repair mechanisms for gene knock-in may provide improved efficiency. For instance, the inventors have recognized and appreciated that NHEJ and MMEJ may account for a large portion of CRISPR/Cas repair products. While template-free repair mechanisms may not always produce desired repair genotypes with sufficiently high frequencies, one or more desired repair genotypes may occur with sufficiently high frequencies in some specific local sequence contexts. For such a local sequence context, template-free repair mechanisms may outperform HDR with respect to simplicity and efficiency.

In some embodiments, one or more of the techniques provided herein may be used to predict, for a given local sequence context, template-free repair genotypes and frequencies of occurrence thereof, which may facilitate designs of gene knock-in or gain-of-function applications. For example, the inventors have recognized and appreciated that some disease-causing alleles, when cut at a selected location by CRISPR/Cas, may exhibit one or just a few repair outcomes that occur at a high frequency and transform the disease-causing allele into one or more healthy alleles. Disease-causing alleles may occur in genomic sequences that code for proteins or regulatory RNAs, or genomic sequences that regulate transcription or other genomic functions.

In some embodiments, one or more of the techniques provided herein may be used to predict, for a given local sequence context, template-free repair genotypes and frequencies of occurrence thereof, which may be used to select desirable one or more guide RNAs when HDR is employed to edit DNA. Since HDR does not occur 100% of the time, the template-free repair genotypes predicted by this method will be a natural byproduct of sites where HDR failed to occur. The one or more techniques provided herein allow these failed HDR byproducts to be predicted and one or more guide RNAs chosen that will produce the most desirable byproducts for HDR failures. For example, a disease-causing allele may be targeted for HDR repair, but if HDR does not occur at a specific site the template-free repair products can be chosen to transform a disease-causing allele into one or more healthy alleles or to not have deleterious effects. Deleterious effects could result from template-free repair that changed a weakly functional allele into a non-functional allele or into a dominant allele that negatively impacted health. In some embodiments, guide RNA selection consists of considering all guide RNAs that are compatible with HDR repair of a disease-causing allele, and for each guide RNA using one or more of the techniques provided herein to predict its template-free repair genotypes. One or more guide RNAs are then selected for use with the HDR template that have the template-free repair genotypes that are most advantageous for health. Alternatively in some embodiments, one or more guide RNAs are then selected for use with the HDR template that have the template-free repair genotypes that are most likely to disrupt gene function.

It should be appreciated that the techniques disclosed herein may be implemented in any of numerous ways, as the disclosed techniques are not limited to any particular manner of implementation. Examples of details of implementation are provided solely for illustrative purposes. For instance, while examples are given where CRISPR/Cas9 is used to perform genome editing, it should be appreciated that aspects of the present application are not so limited. In some embodiments, another genome editing technique, such as CRISPR/Cpf1, may be used. Furthermore, the disclosed techniques may be used individually or in any suitable combination, as aspects of the present disclosure are not limited to the use of any particular technique or combination of techniques.

FIG. 1 shows an illustrative DNA segment 100, in accordance with some embodiments. For instance, the DNA segment 100 may be exon 43 of a dystrophin gene. About 4% of Duchenne's muscular dystrophy cases are caused by mutations in this exon. Therapeutic solutions showing success in clinical trials use antisense oligonucleotides to cause this exon to be skipped during translation, thereby restoring normal dystrophin function.

The inventors have recognized and appreciated that another therapeutic approach may be possible, using genome editing to make permanent changes to dystrophin exon 43. For instance, in some embodiments, CRISPR/Cas9 (or another suitable technique for cutting a DNA sequence, such as CRISPR/Cpf1) may be used to disrupt a donor splice site motif of dystrophin exon 43, and one or more template-free repair mechanisms may restore normal dystrophin function.

In one aspect, the specification discloses a computational model.

In certain embodiments, the computational model can predict and/or compute an optimized or preferred cut site for a DSB-based genome editing system for introducing a genetic change into a nucleotide sequence. In preferred embodiments, the repair does not require homology-based repair mechanisms.

In certain other embodiments, the computational model can predict and/or compute an optimized or preferred cut site for a Cas-based genome editing system for introducing a genetic change into a nucleotide sequence. In preferred embodiments, the repair does not require homology-based repair mechanisms.

In still other embodiments, the computation model provides for the selection of a optimized or preferred guide RNA for use with a Cas-based genome editing system for introducing a genetic change in a genome. In preferred embodiments, the repair does not require homology-based repair mechanisms.

In various embodiments, the computational model is a neural network model having one or more hidden layers.

In other embodiments, the computational model is a deep learning computational model.

In various embodiments, that the DSB-based genome editing system (e.g., a Cas-based genome editing system) edits the genome without relying on homology-based repair.

In various embodiments, that computational model is trained with experimental data to predict the probability of distribution of indel lengths for any given nucleotide sequence and cut site. In other embodiments, computational model is trained with experimental data to predict the probability of distribution of genotype frequencies for any given nucleotide sequence and cut site.

In embodiments, the computational model comprises one or more training modules for evaluating experimental data.

In an embodiment, the computational model comprises: a first training module (305) for computing a microhomology score matrix (305); a second training module (310) for computing a microhomology independent score matrix; and a third training module (315) for computing a probability distribution over 1-bp insertions, wherein once trained with experimental data the computational model computes a probability distribution over indel genotypes and a probability distribution over indel lengths for any given input nucleotide sequence and cut site.

In certain embodiments, the computational model predicts genomic repair outcomes for any given input nucleotide sequence (i.e., context sequence) and cut site.

In certain embodiments, the genomic repair outcomes comprise microhomology deletions, microhomology-less deletions, and 1-bp insertions.

In various embodiments, the one or more modules each comprising one more input features selected from the group consisting of: a target site nucleotide sequence; a cut site; a PAM-sequence; microhomology lengths relative at a cut site, % GC content at a cut site; and microhomology deletion lengths at a cut site.

In certain embodiments, the nucleotide sequence analyzed by the computational model is between about 25-100 nucleotides, 50-200 nucleotides, 100-400 nucleotides, 200-800 nucleotides, 400-1600 nucleotides, 800-3200 nucleotides, and 1600-6400 nucleotide, or more. In various embodiments, the computation model concerns predicting genetic repair outcomes at double-strand breaks cleaves induced by any DSB-based genomic editing system (e.g., CRISPR/Cas9, Cas-base, Cfr1-based, or others). FIG. 1 depicts the anatomy of a double strand break. In the example shown in FIG. 1, the DNA segment 100 includes a top strand 105A and a bottom strand 105B. These two strands are complementary and therefore encode the same information. In some embodiments, CRISPR/Cas9 may be used to create a double strand cut at a selected donor splice site motif, which may be a specific sequence of 6-10 nucleotides. In the example of FIG. 1, an NGG PAM may be used, as underlined and shown at 115, so that a cut site 110 would occur within the selected donor splice site motif. Any suitable algorithm may be used to detect presence or absence of the splice site motif in repair products, thereby verifying if the splice site motif has been successfully eliminated.

FIGS. 2A-D show an illustrative matching of 3' ends of top and bottom strands of a DNA segment at a cut site and an illustrative repair product, in accordance with some embodiments. For instance, the strands may be the illustrative top strand 105A and the illustrative bottom strand 105B of FIG. 1, and the cut site may be the illustrative cut site 110 of FIG. 1. (To avoid clutter, the surrounding sequence context is omitted in FIGS. 2B-D.)

In some embodiments, a segment of double-stranded DNA may be represented such that the top strand runs 5' on the left to 3' on the right. Given a cut in this double stranded DNA, nucleotides and their complementary base-paired nucleotides that lie between the 5' end of the top strand and the cut site may be said to be located at the 5' side of the cut site. Likewise, nucleotides and their complementary base-paired nucleotides that lie between the cut site and the 3' end of the top strand may be said to be located at the 3' side of the cut site.

In the example shown in FIG. 2A, a deletion length of 5 base pairs is considered, for example, as a result of 5' end resection, where the top strand 105A has an overhang 200A of length 5 at the 5' side of the cut site 110, and the bottom strand 105B has an overhang 200B of length 5 at the 3' side of the cut site 110. As shown in FIG. 2B, there is no match between the overhangs 200A and 200B in the first three bases, but there is a match in each of the last two bases. Thus, in this example, a microhomology 205 is present, with a 2 base pair match.

FIG. 2C shows an illustrative result of flap removal, where the three mismatched bases in the overhang 200B are removed. For instance, in some embodiments, given a microhomology, some or all nucleotides on the 3' side of the microhomology on the top strand, and/or some or all nucleotides on the 3' side of the microhomology on the bottom strand, may be resected. Pictorially, with the top strand running 5' to 3', nucleotides to the right of the microhomology on the top strand may be resected, and nucleotides to the left of the microhomology on the bottom strand may be resected.

FIG. 2D shows an illustrative repair product resulting from polymerase fill-in and ligation, where three matching bases are added to the overhang 200B.

FIG. 3A shows an illustrative machine learning model 300, in accordance with some embodiments. The machine learning model 300 may be trained using experimental data to compute, given an input DNA sequence seq and a cut site location, a probability distribution over any suitable set of deletion and/or insertion genotypes, and/or a probability distribution over any suitable set of deletion and/or insertion lengths. For instance, in some embodiments, 1 base pair insertions and 1-60 base pair deletions may be considered. (These repair outcomes may also be referred to herein as +1 to −60 indels.) The inventors have observed empirically that indels outside of this range occur infrequently. However, it should be appreciated that aspects of the present disclosure are not limited to any particular set of repair outcomes. In some embodiments, only insertions (e.g., 1-2 base pair insertions), or only deletions (e.g., 1-28 base pair deletions), may be considered, for example, based on availability of training data.

The inventors have recognized and appreciated that accurate predictions of repair outcomes may be facilitated by separating the repair outcomes into three classes: microhomology (MH) deletions, microhomology-less (MH-less) deletions, and insertions. The inventors have further recognized and appreciated that different machine learning techniques may be applied to the different classes of repair outcomes. For instance, in the example of FIG. 3, the machine learning model 300 includes three modules: the MH deletion module 305, the MH-less deletion module 310, and the insertion module 315. As discussed below, these modules may compute scores for various indel genotypes and/or indel lengths, which may in turn be used to compute a probability distribution over indel genotypes and/or a probability distribution over indel lengths. In some embodiments, one or more modules (e.g., the MH deletion module 305 and the MH-less deletion module 310) may be trained jointly. In some embodiments, a module may be dependent upon one or more other modules. For instance, as discussed below, an input feature used in the insertion module 315 may be derived based on outputs of the MH deletion module 305 and/or the MH-less deletion module 310.

In some embodiments, MH deletions may include deletions that are derivable analytically by simulating MMEJ. For instance, all microhomologies may be identified for deletion lengths of interest (e.g., deletion lengths 1-60). A genotypic outcome may be derived for each such microhomology by simulating polymerase fill-in, for example, as discussed in connection with FIGS. 2A-2D. (The inventors have recognized and appreciated that there is a one-to-one correspondence between the microhomologies and the genotypic outcomes.) A deletion that is derivable in this manner may be classified as a MH deletion, whereas a deletion that is not derivable in this matter may be classified as a MH-less deletion.

Techniques for identifying microhomologies for a given a deletion length L of interest (e.g., each deletion length between 1 and 60) are described below. However, it should be appreciated that aspects of the present disclosure are not limited to the use of any particular technique for identifying microhomologies.

In some embodiments, an input DNA sequence seq may be represented as a vector with integer indices, where each element of the vector is a nucleotide from the set, {A, C, G, T}, and the cut site is between seq[−1] and seq[0], and seq is oriented 5' on the left to 3' on the right. A subsequence seq[i:j], i<j, may be a vector of length j−i, including elements seq[i] to seq[j−1]. For each deletion length L of interest (e.g., L between 1 and 60), left[L] may be used to denote seq[−L: 0], and right[L] may be used to denote seq[0, L]. Thus, with reference to the example shown in FIGS. 1, 2A, left[5] may be ACAAG, and right[5] may be GGTAG. Because the top strand 105A and the bottom strand 105B are complementary, a microhomology (e.g., the microhomology 205) may be identified by looking for exact matches between left[5] and right[5] (which may be equivalent to complementary matches between the overhang 200A and the overhang 200B). For instance, a match vector may be constructed for each deletion length L of interest (e.g., L between 1 and 60) as follows: match[L][i]='|' if left[L][i]=right[L][i], otherwise match[L][i]'.' Such matching between left[5] and right[5] is illustrated below.

ACAAG
...||
GGTAG

In some embodiments, a microhomology may be identified by looking for match[L][i:j] such that match[L][k]='|' for all i≤k≤j and match[L][i]!='|' and match[L][j]!='|'. For instance, with reference to the example shown in FIG. 1, there may be no microhomology for deletion length 3, no microhomology for deletion length 4, one microhomology for deletion length 5, three microhomologies for deletion length 6, etc., as illustrated below.

AAG
...
GGT
...
CAAG
....
GGTA
....
ACAAG
...||
GGTAG
GACAAG
|..|.|
GGTAGG

In some embodiments, microhomologies identified for a suitable set of deletion lengths (e.g., 1-60) may be enumerated using indices n=1 . . . N, where N is the number of identified microhomologies. For each n, let G[n] denote the genotypic outcome corresponding to the microhomology n, let ML [n] denote the microhomology length of the microhomology n, let C[n] denote the GC fraction of the microhomology n, and let DL [n] denote the deletion length of the microhomology n.

Although examples of representations of DNA sequences and subsequences are discussed herein, it should be appreciated that aspects of the present disclosure are not limited to the use of any particular representation.

FIG. 3B shows an illustrative process 350 for building one or more machine learning models for predicting frequencies of deletion genotypes and/or deletion lengths, in accordance with some embodiments. For instance, the process 350 may be used to build the illustrative MH deletion module 305 and/or the illustrative MH-less deletion module 310 in the example of FIG. 3A. These modules may be used to compute, given an input DNA sequence seq and a cut site location, a probability distribution over any suitable set of deletion genotypes and/or a probability distribution over any suitable set of deletion lengths.

In some embodiments, a probability distribution over deletion lengths from 1-60 may be computed. However, it should be appreciated that aspects of the present disclosure are not limited to any particular set of deletion lengths. In some embodiments, an upper limit of deletion lengths may be determined based on availability of training data and/or any other one or more suitable considerations.

Referring to FIG. 3B, act 355 of the process 350 may include, for each deletion length L of interest (e.g., each deletion length between 1-60), aligning subsequences of length L on the 5' and 3' sides of a cut site in an input DNA sequence to identify one or more microhomologies, as discussed in connection with FIG. 3A. This may be performed for an input DNA sequence and a cut site for which repair genotype data from an CRISPR/Cas9 experiment is available.

At act 360, one or more microhomologies identified at act 355 may be featurized. Any suitable one or more features may be used, as aspects of the present disclosure are not so limited. As one example, the inventors have recognized and appreciated that energetic stability of a microhomology may increase proportionately with a length of the microhomology. Accordingly, in some embodiments, a microhomology length j−i may be used as a feature for a microhomology match[L][i:j].

As another example, the inventors have recognized and appreciated that thermodynamic stability of a microhomology may depend on specific base pairings, and that G-C pairings have three hydrogen bonds and therefore have higher thermodynamic stability than A-T pairings, which have two hydrogen bonds. Accordingly, in some embodiments, a GC fraction, as shown below, may be used as a feature for a microhomology match[L][i:j], where indicator (boolean) equals 1 if boolean is true, and 0 otherwise.

$$\frac{\sum_{k=i}^{j-1} \text{indicator(top}[L][k] = \text{'G' or 'C'})}{j-i}$$

In some embodiments, a length N vector may be constructed for each feature (e.g., microhomology length, GC fraction, etc.), where N is the number of microhomologies identified at act 355 for a set of deletion lengths of interest (e.g., 1-60), as discussed in connection with FIG. 3A. As discussed above, the inventors have recognized and appreciated that there is a one-to-one correspondence between microhomologies and genotypic outcomes that are classified as MH deletions. Therefore, feature vectors for microhomologies may be viewed as feature vectors for MH deletions.

In some embodiments, acts 355 and 360 may be repeated for different input DNA sequences and/or cut sites for which repair genotype data from CRISPR/Cas9 experiments is available.

It should be appreciated that aspects of the present disclosure are not limited to any particular featurization technique. For instance, in some embodiments, two features may be used, such as microhomology length and GC fraction. However, that is not required, as in some embodiments one feature may be used (e.g., microhomology length, GC fraction, or some other suitable feature), or more than two features may be used (e.g., three, four, five, etc.). Examples of features that may be used for a microhomology match [L][i:j] within a deletion of length L include, but are not limited to, a position of the microhomology within the deletion (e.g., as represented by $$\frac{\sum_{k=i}^{j-1} k}{L*(j-i)}$$

and a ratio between a length of the microhomology (i.e., j−i) and the L*(j−i) deletion length L. As another example, the inventors have recognized and appreciated that deoxyribonuclease (DNase) hypersensitivity may be used to classify genomic sequences into open or closed chromatin, which may impact DNA repair outcomes. Accordingly, in some embodiments, open vs. closed chromatin may be used as a feature. Any one or more of these features, and/or other features, may be used in addition to, or instead of, microhomology length and GC fraction. Furthermore, in some embodiments, explicit featurization may be reduced or eliminated by automatically learning data representations (e.g., using one or more deep learning techniques). Returning to FIG. 3B, one or more machine learning models may be trained at act 365 to compute one or more target probability distributions. For instance, a neural network model may be built for the illustrative MH deletion module 305 in the example of FIG. 3A. This model may take as input a length N vector for each of one or more features, as constructed at act 360, and output a length N vector of MH scores, where N is the number of microhomologies identified at act 355 for a set of deletion lengths of interest (e.g., 1-60). Additionally, or alternatively, a neural network model may be built for the illustrative MH-less deletion module 310 in the example of FIG. 3A. This model may take as input a vector for each of one or more features, and output a vector of MH-less scores. Both of the input vector and the output vector may be indexed by the set of deletion lengths of interest (e.g., 1-60) These neural network models may then be trained jointly using repair genotype data collected from CRISPR/Cas9 experiments.

Figure 4A:
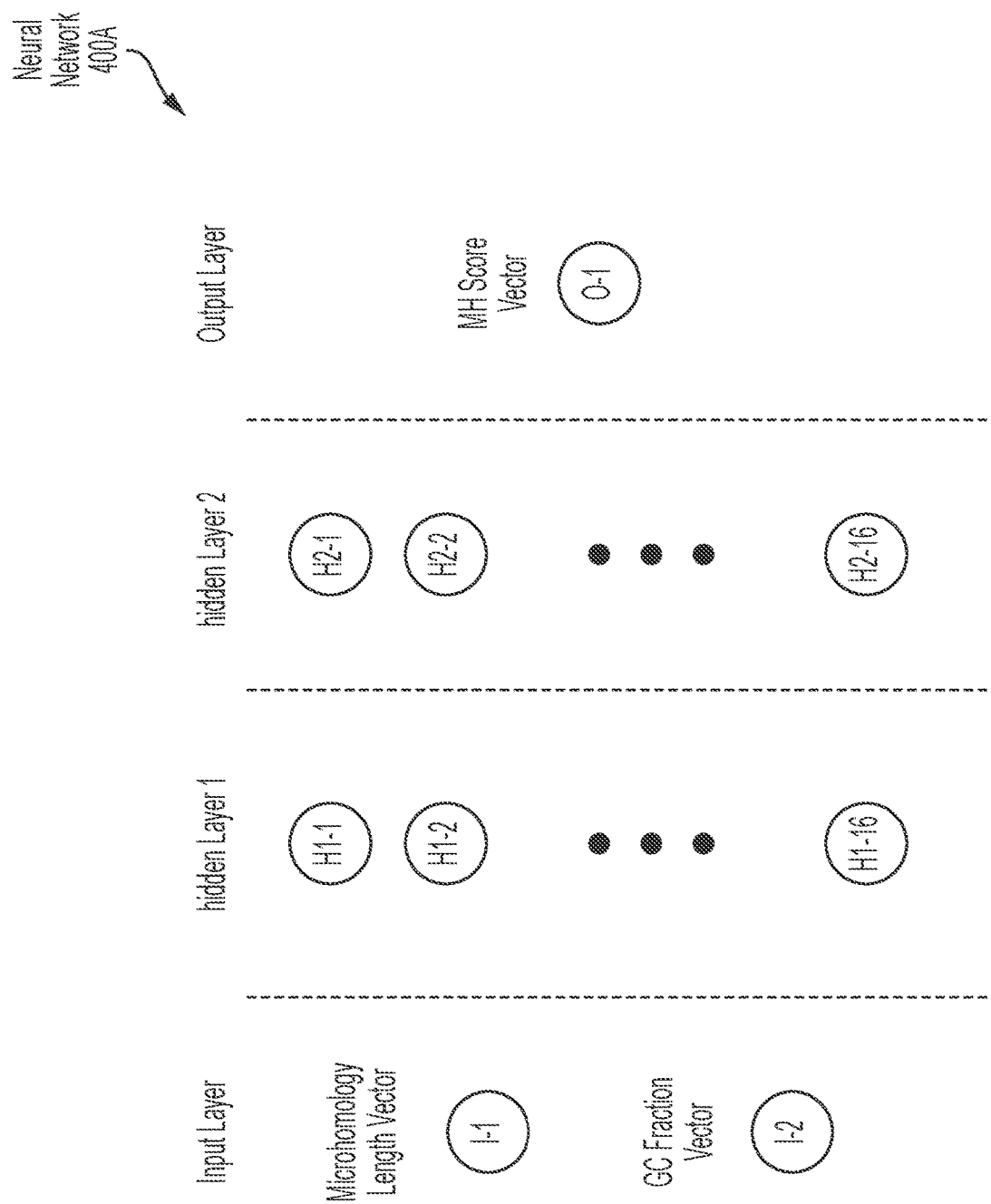
FIG. 4A shows an illustrative neural network 400A for computing microhomology (MH) scores, in accordance with some embodiments.

FIG. 4A shows an illustrative neural network 400A for computing MH scores, in accordance with some embodiments. For instance, the neural network 400A may be used in the illustrative MH deletion module 305 in the example of FIG. 3A, and may be trained at act 365 of the illustrative process 350 shown in FIG. 3B.

In some embodiments, the neural network 400A may have one input node for each microhomology feature being used. For instance, in the example shown in FIG. 4A, there are two input nodes, which are associated with microhomology length and GC fraction, respectively. Each input node may receive a length N vector, where N is the number of microhomologies identified for a set of deletion lengths of interest (e.g., 1-60), for example, as discussed in connection with act 355 in the example of FIG. 3B.

In some embodiments, the neural network 400A may include one or more hidden layers, each having one or more nodes. In the example shown in FIG. 4A, there are two hidden layers, each having 16 nodes. However, it should be appreciated that aspects of the present disclosure are not limited to the use of any particular number of hidden layers or any particular number of nodes in a hidden layer. Furthermore, different hidden layers may have different numbers of nodes.

In some embodiments, the neural network 400A may be fully connected. (To avoid clutter, the connections are not illustrated in FIG. 4A.) However, that is not required. For instance, in some embodiments, a dropout technique may be used, where a parameter p may be selected, and during training each node's value is independently set to 0 with probability p. This may result in a neural network that is not fully connected.

In some embodiments, a leaky rectified linear unit (ReLU) nonlinearity sigma may be used in the neural network 400A. For instance, at hidden layer h and node i, an activation function may be provided as follows:

unit[h][i]=sigma(w[h][i]*unit[h−1]+b[h][i]), where
sigma(x)=max(0, x)+0.001*min(0, x).

Thus, the neural network 400A may be parameterized by w[h] and b[h] for each hidden layer h. In some embodiments, these parameters may be initialized randomly, for example, from a spherical Gaussian distribution with some suitable center (e.g., 0) and some suitable variance (e.g., 0.1). These parameters may then be trained using repair genotype data collected from CRISPR/Cas9 experiments, for instance, as discussed below.

In some embodiments, the neural network 400A may have one output node, producing a length N vector $\psi_{MH}$ of scores, where N is the number of microhomologies identified for the set of deletion lengths of interest (e.g., 1-60). Thus, there may be one score for each identified microhomology.

In some embodiments, the neural network 400A may operate independently for each microhomology, taking as input the length of that microhomology (from the first input node) and the GC fraction of that microhomology (from the second input node), transforming those two values into 16 values (at the first hidden layer), then transforming those 16 values into 16 other values (at the second hidden layer), and finally outputting a single value (at the output node). In such an embodiment, parameters for the first hidden layer, w[1][i] and b[1][i], are vectors of length 2 for each node i from 1 to 16, whereas parameters for the second hidden layer, w[2][i] and b[2][i], are vectors of length 16 for each node i from 1 to 16, and parameters for the output layer, w[3][1] and b[3][1], are also vectors of length 16.

In some embodiments, the vector $\psi_{MH}$ of raw scores may be converted into a vector $\phi_{MH}$ of MH scores. The inventors have recognized and appreciated (e.g., from experimental data) that the strength of a microhomology decreases exponentially with deletion length. Accordingly, in some embodiments, an exponential linear model may be used to convert the raw scores into the MH scores. For instance, the following formula may be used:

$$\phi_{MH}[n]=\exp(\psi_{MH}[n]-DL[n]*0.25),$$

where n is an index for a microhomology (and thus a number between 1 and N), and DL [n] is the deletion length of the microhomology n.

In some embodiments, 0.25 may be a hyperparameter value chosen to improve training speed by appropriate scaling. However, it should be appreciated that aspects of the present disclosure are not limited to the use of any particular hyperparameter value for exponential conversion, or any conversion at all. In some embodiments, the vector P of raw scores may be used directly as MH scores.

Figure 4B:
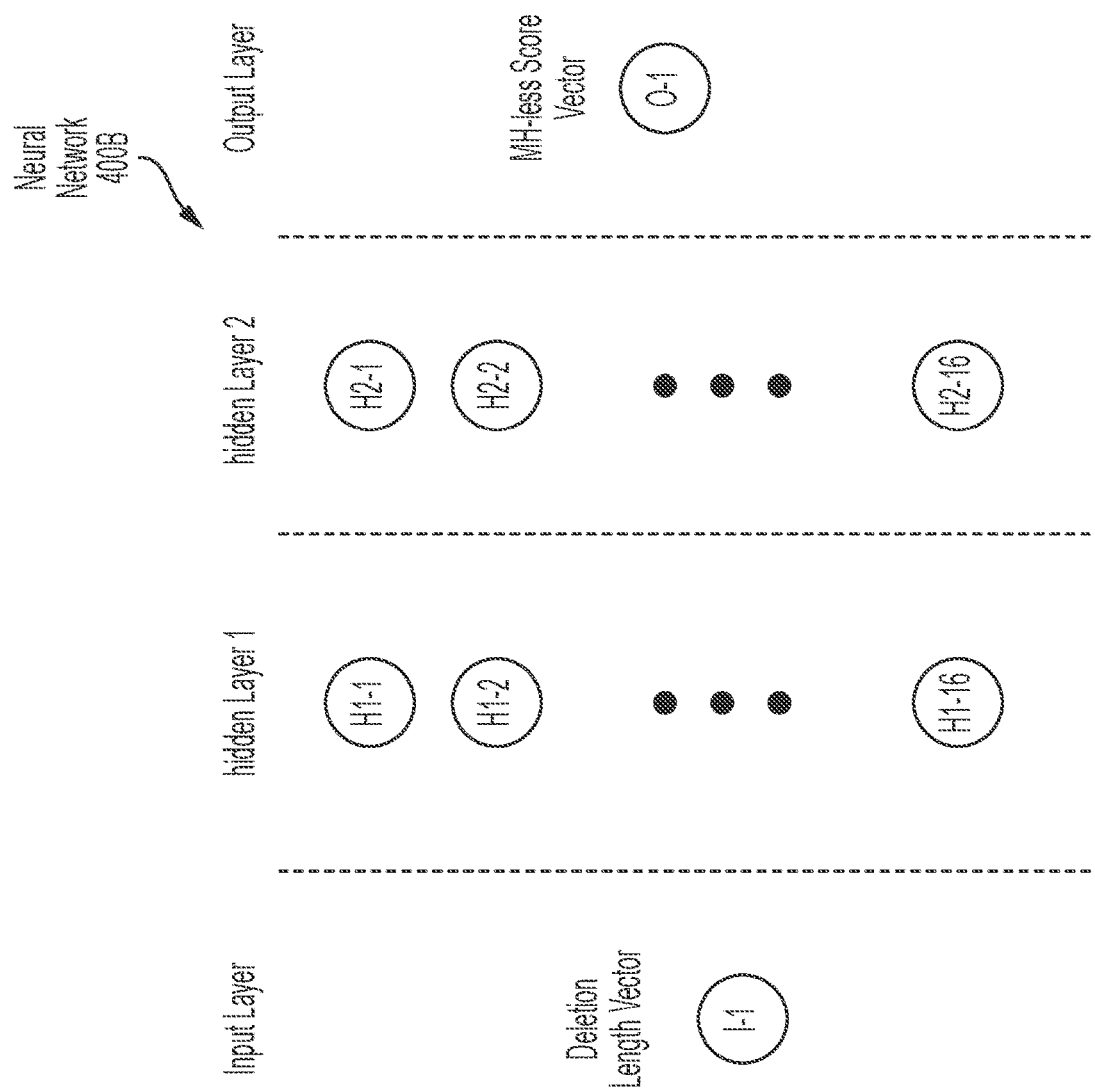
FIG. 4B shows an illustrative neural network 400B for computing MH-less scores, in accordance with some embodiments.

FIG. 4B shows an illustrative neural network 400B for computing MH-less scores, in accordance with some embodiments. For instance, the neural network 400B may be used in the illustrative MH-less deletion module 310 in the example of FIG. 3A, and may be trained at act 365 of the illustrative process 350 shown in FIG. 3B.

In some embodiments, deletion length may be modeled explicitly as an input to the neural network 400B. Thus, in an example where the set of deletion lengths of interest is 1-60, an input node of the neural network 400B may receive a deletion length vector, [1, 2, . . . , 60].

In some embodiments, the neural network 400B may include one or more hidden layers, each having one or more nodes. In the example shown in FIG. 4B, the neural network 400B has two hidden layers that are similarly constructed as the illustrative neural network 400A in the example of FIG. 4A. However, it should be appreciated that aspects of the present disclosure are not limited to the use of a similar construction between the neural network 400A and the neural network 400B.

In some embodiments, the neural network 400B may have an output node producing a vector $\psi_{MH\text{-}less}$ of scores. There may be one score for each deletion length L of interest. Thus, in an example where the set of deletion lengths of interest is 1-60, the length of the vector $\psi_{MH\text{-}less}$ may be 60.

In some embodiments, an exponential linear model may be used to convert the vector $\psi_{MH\text{-}less}$ into a vector $\phi_{MH\text{-}less}$ of MH-less scores. For instance, the following formula may be used:

$$\phi_{MH\text{-}less}[L]=\exp(\psi_{MH\text{-}less}[L]-L*0.25),$$

where L is a deletion length of interest. However, it should be appreciated that aspects of the present disclosure are not limited to the use of any particular hyperparameter value for exponential conversion, or any conversion at all.

Figure 4C:
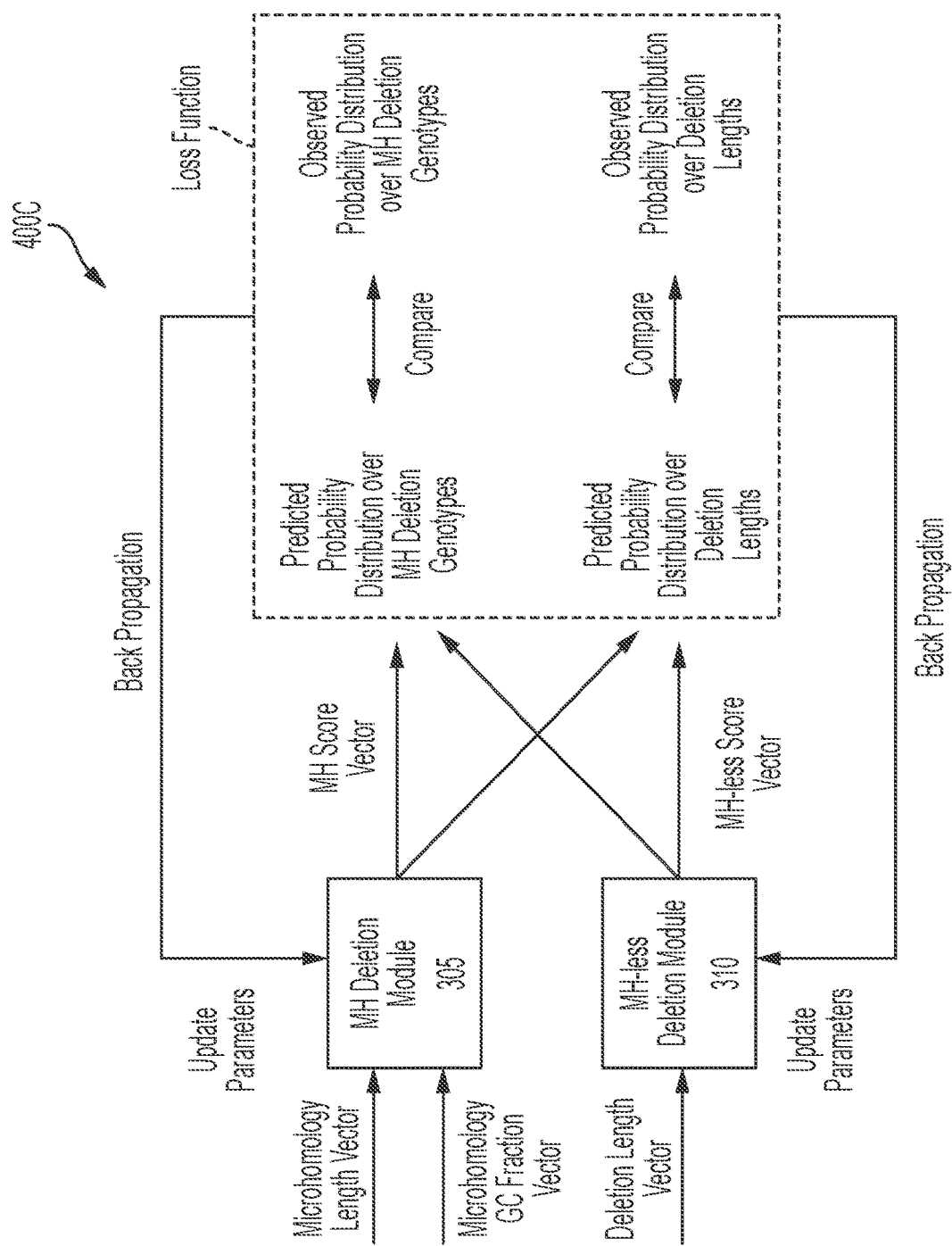
FIG. 4C shows an illustrative process 400C for training two neural networks jointly, in accordance with some embodiments.

FIG. 4C shows an illustrative process 400C for training two neural networks jointly, in accordance with some embodiments. For instance, the process 400C may be used to jointly train the illustrative neural networks 400A and 400B of FIGS. 4A-4B.

In some embodiments, the MH score vector $\phi_{MH}$ and the MH-less score vector may be used to predict a probability distribution over MH deletion genotypes and/or a probability distribution over deletion lengths. For instance, given a microhomology n, a frequency may be predicted for the corresponding MH deletion genotype, out of all MH deletion genotypes. As discussed above, the inventors have recognized and appreciated that there is a one-to-one correspondence between microhomologies and genotypic outcomes that are classified as MH deletions. Thus, n=1 . . . N may be used as an index both for microhomologies and for MH deletions.

In some embodiments, a frequency prediction for a microhomology n may depend on whether the microhomology n is full. A microhomology n is said to be full if the length of the microhomology n is the same as the deletion length associated with the microhomology n. For a microhomology n that is not full, a frequency may be predicted as follows, out of all MH deletion genotypes.

$$V_{MHG}[n] = \frac{\phi_{MH}[n]}{\sum_{m=1}^{N}\phi_{MH}[m] + \sum_{m=1}^{N}\phi_{MH\text{-}less}[L[m]] * \text{indicator (microhomology } m \text{ is full)}}$$

Here DL [m] denotes the deletion length of the microhomology m, and indicator(boolean) equals 1 if boolean is true, and 0 otherwise.

The inventors have recognized and appreciated that, for a full microhomology, only a single deletion genotype is possible for the entire deletion length. Moreover, the single genotype may be generated via different pathways, such as MMEJ and MH-less end-joining. Therefore, full microhomologies may be modeled as receiving contributions from MH-dependent and an MH-less mechanisms. Thus, for a microhomology n that is full, a frequency may be predicted as follows, out of all MH deletion genotypes.

$$V_{MHG}[n] = \frac{\phi_{MH}[n] + \phi_{MH-less}[DL[n]]}{\sum_{m=1}^{N} \phi_{MH}[m] + \sum_{m=1}^{N} \phi_{MH-less}[DL[m]] * \text{indicator (microhomology } m \text{ is full)}}$$

Because the predicted frequencies are normalized. $V_{MHG}$ is a probability distribution over all microhomologies identified for the set of deletion lengths of interest, and hence also a probability distribution over all MH deletions.

In some embodiments, given a deletion length L, a frequency may be predicted as follows for the set of all deletions having the deletion length L, out of all deletions, taking into account contributions from MH-dependent and MH-less mechanisms.

$$V_{DL}[L] = \frac{\sum_{m=1}^{N} \phi_{MH}[m] * \text{indicator } (DL[m] == L) + \phi_{MH-less}[L]}{\sum_{m=1}^{N} \phi_{MH}[m] + \sum_{l=1}^{60} \phi_{MH-less}[l]}$$

Here DL [m] denotes the deletion length of the microhomology m, and indicator(boolean) equals 1 if boolean is true, and 0 otherwise.

In some embodiments, the parameters w[h] and b[h] for each hidden layer h of the neural networks 400A and 400B may be trained using a gradient descent method with L2-loss:

Loss=$\Sigma_{m=1}^{N}(V_{MHG}[m]-V_{MHG}*[m])^2+\Sigma_{l=1}^{60}(V_{DL}[l]-V_{DL}*[l])^2$, where $V_{MHG}*$ is an observed probability distribution on MH deletion genotypes, and $V_{DL}*$ is an observed probability distribution on deletion lengths (e.g., based on repair genotype data collected from CRISPR/Cas9 experiments).

In some embodiments, multiple instantiations of the neural networks 400A and 400B may be trained with different loss functions. For instance, in addition to, or instead of L2-loss, a squared Pearson correlation function may be used.

Loss=−(pearsonr($V_{MHG}[m]$, $V_{MHG}*[m]$))$^2$−(pearsonr($V_{MHG}[m],V_{MHG}*[m]$))$^2$ The function pearsonr(x, y) may be defined as follows for length N vectors x and y, where $\bar{x}$ and $\bar{y}$ denote the averages of x and y, respectively.

$$pearsonr(x, y) = \frac{\sum_{m=1}^{N} (x[m] - \bar{x})(y[m] - \bar{y})}{\sqrt{\sum_{m=1}^{N} (x[m] - \bar{x})^2} \sqrt{\sum_{m=1}^{N} (y[m] - \bar{y})^2}}$$

Although neural networks are used in the examples shown in FIGS. 4A-4C, it should be appreciated that aspects of the present disclosure are not so limited. For instance, in some embodiments, one or more other types of machine learning techniques, such as linear regression, non-linear regression, random-forest regression, etc., may be used additionally or alternatively.

Furthermore, in some embodiments, one or more neural networks that are different from the neural networks 400A and 400B may be used additionally or alternatively. As one example, a different activation function may be used for one or more nodes, such as sigma(x)=max(0, x) (rectified linear unit, or ReLU), sigma(x)=max(0.001x, x) (another example of leaky ReLU), sigma(x)=0.5*(tanh (x)+1.0) or $$sigma(x) = \frac{1}{1 + e^{-x}} \text{ (Sigmoid),}$$

sigma(x)=max(0, x)+min(0, x)*0.5*(tanh(x)+1) (Swish), etc. As another example, batch normalization may be performed at one or more hidden layers. It should be appreciated that aspects of the disclosure are not limited to training the neural networks 400A and 400B jointly. For instance, given a microhomology n, a frequency may be predicted as follows for the corresponding MH deletion genotype, out of all MH deletion genotypes.

$$V'_{MHG}[n] = \frac{\phi_{MH}[n]}{\sum_{m=1}^{N} \phi_{MH}[m]}$$

Since this prediction does not depend on the $\phi_{MH-less}$ scores, the neural network 400A may be trained independently.

In some embodiments, one or more other probability distributions may be predicted in addition to, or instead of $V_{MHG}$ and $V_{DL}$. As one example, given a microhomology n, a frequency may be predicted as follows for the corresponding MH deletion genotype, out of all deletion genotypes (both MH and MH-less).

$$V''_{MHG}[n] = \frac{\phi_{MH}[n]}{\sum_{m=1}^{N} \phi_{MH}[m] + \Sigma_{l=1}^{60} \phi_{MH-less}[l]}$$

As another example, for a microhomology n that is not full, a frequency may be predicted as follows, out of all deletion genotypes (both MH and MH-less).

$$V'''_{MHG}[n] = \frac{\phi_{MH}[n]}{\sum_{m=1}^{N} \phi_{MH}[m] + \sum_{l=1}^{60} \phi_{MH-less}[l]}$$

For a microhomology n that is full, a frequency may be predicted as follows, out of all deletion genotypes (both MH and MH-less).

$$V''''_{MHG}[n] = \frac{\phi_{MH}[n] + \phi_{MH-less}[DL(n)]}{\sum_{m=1}^{N} \phi_{MH}[m] + \sum_{l=1}^{60} \phi_{MH-less}[l]}$$

Here DL [n] denotes the deletion length of the microhomology n.

As another example, given a deletion length L, a frequency may be predicted as follows for the set of MH-less deletions having the deletion length L, out of all MH-less deletion genotypes.

$$V'_{DL}[L] = \frac{\phi_{MH-less}[L]}{\sum_{l=1}^{60} \phi_{MH-less}[l]}$$

As another example, given a deletion length L, a frequency may be predicted as follows for the set of MH-less deletions having the deletion length L, out of all deletion genotypes (both MH and MH-less).

$$V''_{DL}[L] = \frac{\phi_{MH-less}[L]}{\sum_{m=1}^{N} \phi_{MH}[m] + \sum_{l=1}^{60} \phi_{MH-less}[l]}$$

Any one or more of the above predicted probability distributions may be used to train the neural networks 400A and 400B, with some suitable loss function.

Figure 4D:
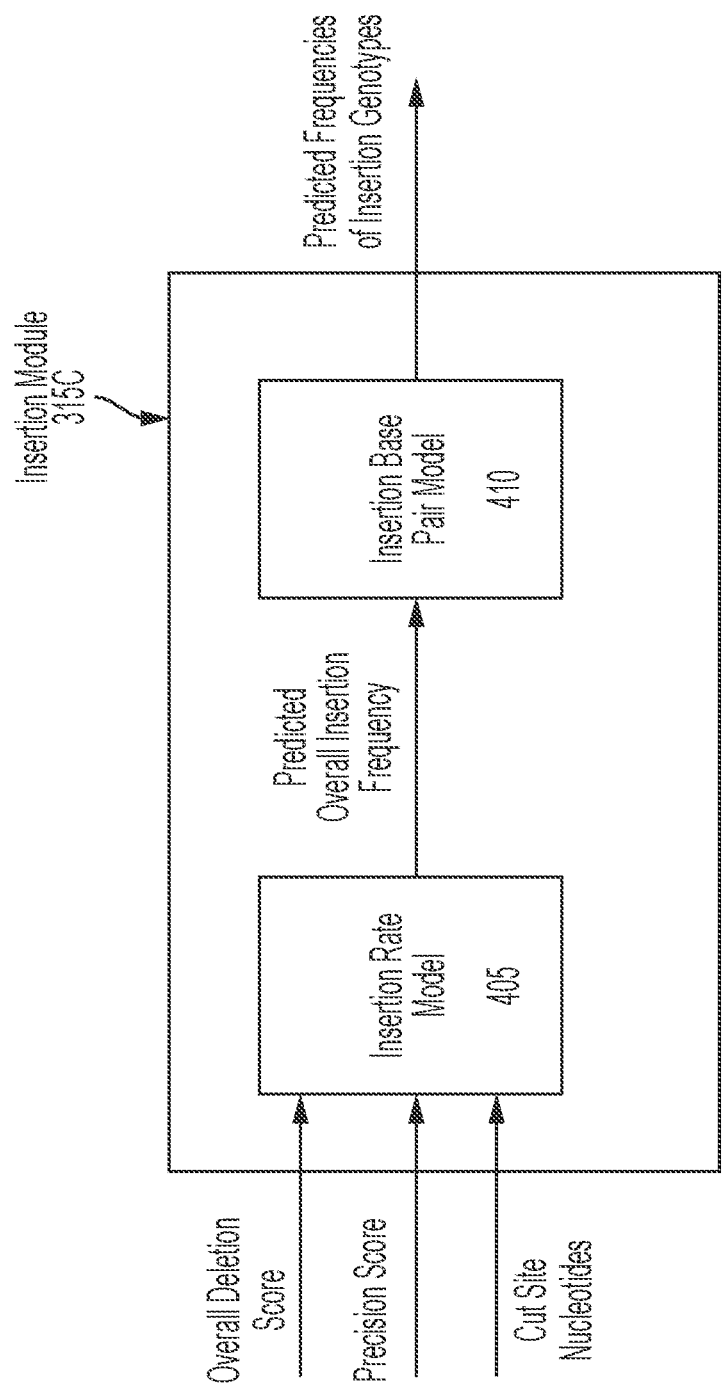
FIG. 4D shows an illustrative implementation of the insertion module 315 shown in FIG. 3A, in accordance with some embodiments.

FIG. 4D shows an illustrative implementation of the insertion module 315 shown in FIG. 3A, in accordance with some embodiments. In this example, the insertion module 315 includes two models. First, an insertion rate model 405 may be constructed to predict, given an input DNA sequence and a cut site, a frequency of 1 base pair insertions out of all +1 to −60 indels (i.e., 1 base pair insertions and 1-60 base pair deletions). Second, an insertion base pair model 410 may be constructed to predict frequencies of 1 base pair insertion genotypes (i.e., A, C, G, T), again out of all +1 to −60 indels (i.e., 1 base pair insertions and 1-60 base pair deletions). However, it should be appreciated that aspects of the present disclosure are not limited to any particular set of indels. In some embodiments, a small set of indels (e.g., 1 base pair insertions and 1-28 base pair deletions) may be considered, for instance, when less training data is available.

In some embodiments, the insertion rate model 405 may have one or more input features, which may be encoded as an M-dimensional vector of values for some suitable M. The insertion rate model 405 may have at least one output value. A set of training data for the insertion rate model 405 may include a plurality of M-dimensional training vectors and respective output values. Given an M-dimensional query vector, a k-nearest neighbor (k-NN) algorithm with weighting by inverse distance may be used to compute a predicted output value for the query vector. For instance, k=5 may be used, and five training vectors that are closest to the query vector may be identified, and a predicted output value for the query vector may be computed as a sum of the output values corresponding to the five closest training vectors, weighted by inverse distance, as follows.

$$y = \sum_{i=1}^{5} \hat{y}[i] * \left( \frac{\sum_{j=1}^{5} d(x, \hat{x}[j]) - d(x, \hat{x}[i])}{\sum_{j=1}^{5} d(x, \hat{x}[j])} \right)$$

Here x is the query vector, d is a distance function for the M-dimensional vector space, $\hat{x}[1], \ldots, \hat{x}[5]$ are the five closest training vectors, $\hat{y}[1], \ldots, \hat{y}[5]$ are the output values corresponding respectively to $\hat{x}[1], \ldots, \hat{x}[5]$, and y is the predicted output value for the query vector x.

It should be appreciated that aspects of the present disclosure are not limited to the use of any particular k, or to the use of any k-NN algorithm. For instance, any one or more of the following techniques, and/or Bayesian variants thereof, may be used in addition to, or instead of k-NN: gradient-boosted regression, linear regression, nonlinear regression, multilayer perceptron, deep neural network, etc. Also, any suitable distance metric d may be used, such as Euclidean distance.

In some embodiments, the insertion rate model 405 may have three input features: overall deletion score, precision score, and one or more cut site nucleotides. The overall deletion score may be computed based on outputs of the MH deletion module 305 and the MH-less deletion module 310 in the example of FIG. 3A, for instance, as follows.

$$\phi = \sum_{m=1}^{N} \phi_{MH}[m] + \sum_{l=1}^{60} \phi_{MH-less}[l]$$

Alternatively, log (ϕ) may be used as the overall deletion score.

In some embodiments, the precision score may be indicative of an amount of entropy in predicted frequencies of a suitable set of deletion lengths. The inventors have recognized and appreciated that it may be desirable to calculate precision based on a large set of deletion lengths, but in some instances a smaller set (e.g., 1-28) may be used due to one or more constraints associated with available data. As discussed above, given a deletion length L, a frequency may be predicted as follows for the set of all deletions having the deletion length L, out of all deletions, taking into account contributions from MH-dependent and MH-less mechanisms.

$$V_{DL}[L] = \frac{\sum_{m=1}^{N} \phi_{MH}[m] * \text{indicator}(DL[m] == L) + \phi_{MH-less}[L]}{\sum_{m=1}^{N} \phi_{MH}[m] + \sum_{l=1}^{60} \phi_{MH-less}[l]}$$

Here DL [m] denotes the deletion length of the microhomology m, and indicator(boolean) equals 1 if boolean is true, and 0 otherwise. The precision score may be computed as follows.

$$\text{precision} = 1 - \frac{-\sum_{L=1}^{28} V_{DL}[L] * \log(V_{DL}[L])}{\log(28)}$$

In some embodiments, the one or more cut site nucleotides may include nucleotides on either side of the cut site (i.e., seq[−1] and seq[0]). In the example shown in FIG. 1, the cut site nucleotides are G and G, which are the third and fourth nucleotides to the left of the PAM sequence 115. However, it should be appreciated that aspects of the present disclosure are not limited to the use of two cut side nucleotides as input features to the insertion rate model 405. For instance, only one cut side nucleotide (e.g., seq[−1], which may be the fourth nucleotide to the left of the PAM sequence) may be used when less training data is available, whereas more than two cut side nucleotides (e.g., seq[−2], seq[−1], and seq[0], which may be the third, fourth, and fifth nucleotides to the left of the PAM sequence) may be used when more training data is available.

In some embodiments, one or more input features to the insertion rate model 405 may be encoded in some suitable manner. For instance, the one or more cut site nucleotides may be one-hot encoded, for example, as follows.

$$A=1000, C=0100, G=0010, T=0001$$

In some embodiments, encoded input features may be concatenated to form an input vector. In an example in which two cut side nucleotides are used, an input vector may have a length of 10: four for each of the two cut side nucleotides, one for the precision score, and one for the overall deletion score.

In some embodiments, training data for a certain input DNA sequence may be organized into a matrix X. Each row in the matrix (X[i, –]) may correspond to a possible cut site, and may store a length M training vector for that cut site (e.g., M=10). In some embodiments, each column in the matrix (X[–,j]) may be normalized to mean 0 and variance 1, as follows.

$$X[i, j] = \frac{X[i, j] - \text{mean}(X[-, j])}{\text{var}(X[-, j])}$$

In some embodiments, values in a query vector may be normalized in a like fashion. For instance, a jth value in a query vector x may be normalized as follows.

$$x[i] = \frac{x[j] - \text{mean}(X[-, j])}{\text{var}(X[-, j])}$$

In some embodiments, an output value may be computed for each row in the training matrix X. For instance, an output value Y[i], i corresponding to a possible cut site, may be a frequency of observed 1 base pair insertions, relative to all observed +1 to −60 indels, at that cut site.

In some embodiments, the insertion base pair model 410 may be constructed to predict frequencies of 1 base pair insertion genotypes (i.e., A, C, G, T). For instance, the insertion base pair model 410 may predict that the probability of a certain insertion genotype given one or more cut site nucleotides is the same as the frequency of that insertion genotype as observed in a subset of training data in which those one or more cut site nucleotides are observed. Thus, given an input DNA sequence seq and a cut site, the insertion base pair model 410 may determine one or more cut site nucleotides (e.g., seq[−1]="C"). The insertion base pair model 410 may then score the insertion genotypes A as follows.

$$\phi_{ins}["A"] = y * \text{ObsFreq}("A" | \text{seq}[-1] = "C")$$

Here y is the frequency of 1 base pair insertions as predicted by the insertion rate model 405, and ObsFreq("A" | seq[−1]="C") is the observed frequency of insertion genotype A given that the nucleotide to the left of the cut site C. The other three insertion genotypes may be scored similarly.

In some embodiments, more than one cut site nucleotides may be considered. For instance, the insertion base pair model 410 may determine that seq[−2]="A", seq[−1]="C", and seq[0]="G". The insertion base pair model 410 may then score the insertion genotypes A as follows, and the other three insertion genotypes may be scored similarly.

$$\phi_{ins}["A"] = y * \text{ObsFreq}("A" | \text{seq}[-2] = "A" \& \text{seq}[-1] = "C" \& \text{seq}[0] = "G")$$

In some embodiments, a frequency of 1 base pair insertion genotype A, out of all +1 to −60 indels (i.e., 1 base pair insertions and 1-60 base pair deletions), may be predicted as follows. Frequencies for the other three insertion genotypes may be predicted similarly.

$$V_{ins}["A"] = \frac{\phi_{ins}["A"]}{\sum_{m=1}^{N} \phi_{MH}[m] + \sum_{l=1}^{60} \phi_{MH-less}[l] + \phi_{ins}["A"] + \phi_{ins}["C"] + \phi_{ins}["G"] + \phi_{ins}["T"]}$$

In some embodiments, a frequency of 1 base pair insertions, out of all +1 to −60 indels (i.e., 1 base pair insertions and 1-60 base pair deletions), may be predicted as follows.

$$V_{ins} = \frac{\phi_{ins}["A"] + \phi_{ins}["C"] + \phi_{ins}["G"] + \phi_{ins}["T"]}{\sum_{m=1}^{N} \phi_{MH}[m] + \sum_{l=1}^{60} \phi_{MH-less}[l] + \phi_{ins}["A"] + \phi_{ins}["C"] + \phi_{ins}["G"] + \phi_{ins}["T"]}$$

In some embodiments, given a deletion length L, a frequency may be predicted as follows for the set of all deletions having the deletion length L, out of all +1 to −60 indels (i.e., 1 base pair insertions and 1-60 base pair deletions), taking into account contributions from MH-dependent and MH-less mechanisms.

$$V_{DL+ins}[L] = \frac{\sum_{m=1}^{N} \phi_{MH}[m] * \text{indicator}(DL[m] == L) + \phi_{MH-less}[L]}{\sum_{m=1}^{N} \phi_{MH}[m] + \sum_{l=1}^{60} \phi_{MH-less}[l] + \phi_{ins}["A"] + \phi_{ins}["C"] + \phi_{ins}["G"] + \phi_{ins}["T"]}$$

In some embodiments, given a deletion length L, a frequency may be predicted as follows for the set of MH-less deletions having the deletion length L, out of all +1 to −60 indels (i.e., 1 base pair insertions and 1-60 base pair deletions).

$$V''_{DL+ins}[L] = \frac{\phi_{MH-less}[L]}{\sum_{m=1}^{N} \phi_{MH}[m] + \sum_{l=1}^{60} \phi_{MH-less}[l] + \phi_{ins}["A"] + \phi_{ins}["C"] + \phi_{ins}["G"] + \phi_{ins}["T"]}$$

In some embodiments, given a microhomology n, a frequency may be predicted as follows for the corresponding MH deletion genotype, out of all +1 to −60 indels (i.e., 1 base pair insertions and 1-60 base pair deletions).

$$V''_{MHG+ins}[n] = \frac{\phi_{MH}[n]}{\sum_{m=1}^{N} \phi_{MH}[m] + \sum_{l=1}^{60} \phi_{MH-less}[l] + \phi_{ins}["A"] + \phi_{ins}["C"] + \phi_{ins}["G"] + \phi_{ins}["T"]}$$

In some embodiments, for a microhomology n that is not full, a frequency may be predicted as follows, out of all +1 to −60 indels (i.e., 1 base pair insertions and 1-60 base pair deletions).

$$V'''_{MHG+ins}[n] = \frac{\phi_{MH}[n]}{\sum_{m=1}^{N}\phi_{MH}[m] + \sum_{l=1}^{60}\phi_{MH-less}[l] + \phi_{ins}["A"] + \phi_{ins}["C"] + \phi_{ins}["G"] + \phi_{ins}["T"]}$$

For a microhomology n that is full, a frequency may be predicted as follows, out of all all +1 to −60 indels (i.e., 1 base pair insertions and 1-60 base pair deletions).

$$V'''_{MHG+ins}[n] = \frac{\phi_{MH}[n] + \phi_{MH-less}[DL(n)]}{\sum_{m=1}^{N}\phi_{MH}[m] + \sum_{l=1}^{60}\phi_{MH-less}[l] + \phi_{ins}["A"] + \phi_{ins}["C"] + \phi_{ins}["G"] + \phi_{ins}["T"]}$$

Here DL [n] denotes the deletion length of the microhomology n.

Figure 5:
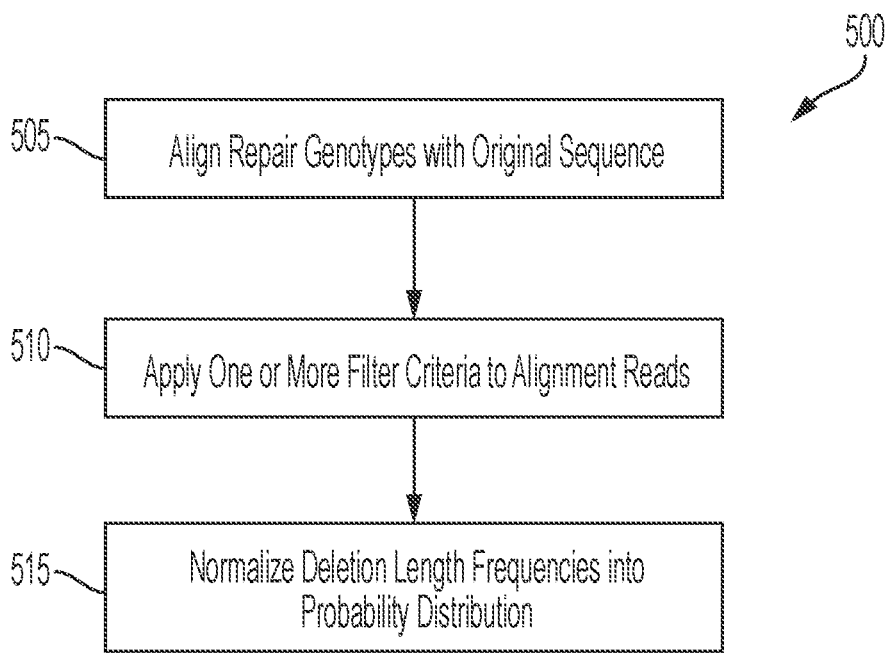
FIG. 5 shows an illustrative process 500 for processing data collected from CRISPR/Cas9 experiments, in accordance with some embodiments.

FIG. 5 shows an illustrative process 500 for processing data collected from CRISPR/Cas9 experiments, in accordance with some embodiments. For instance, the process 500 may be performed for each input DNA sequence and CRISPR/Cas9 cut site, and a resulting dataset may be used to train the illustrative computational models described in connection with FIGS. 4A-4D.

At act 505, repair genotypes observed from CRISPR/Cas 9 experiments may be aligned with an original DNA sequence. Any suitable technique may be used to observe the repair genotypes, such as Illumina DNA sequencing. Any suitable alignment algorithm may be used for alignment, such as a Needleman-Wunsch algorithm with some suitable scoring parameters (e.g., +1 for match, −2 for mismatch, −4 for gap open, and −1 for gap extend, or +1 for match, −1 for mismatch, −5 for gap open, and −0 for gap extend).

At act 510, one or more filter criteria may be applied to alignment reads from act 505. For instance, in some embodiments, only those reads in which a deletion includes at least one base directly 5' or 3' of the CRISPR/Cas9 cut site are considered. This may filter out deletions that are unlikely to have resulted from CRISPR/Cas9.

At act 515, frequencies of indels of interest (e.g., from +1 to −60) may be normalized into a probability distribution.

Figure 6:
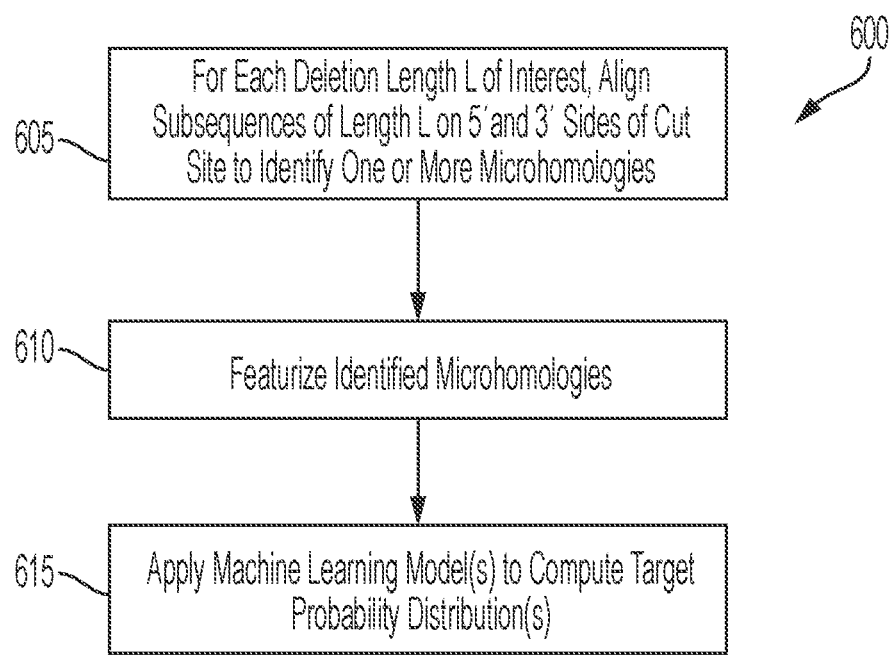
FIG. 6 shows an illustrative process 600 for using a machine learning model to predict frequencies of indel genotypes and/or indel lengths, in accordance with some embodiments.

FIG. 6 shows an illustrative process 600 for using a machine learning model to predict frequencies of indel genotypes and/or indel lengths, in accordance with some embodiments. Acts 605 and 610 may be similar to, respectively, acts 355 and 360 of the illustrative process 350 of FIG. 3B, except that acts 605 and 610 may be performed for an input DNA sequence seq and a cut site location for which repair genotype data from an CRISPR/Cas9 experiment may not be available. At act 615, one or more machine learning models, such as the machine learning models trained at act 365 of the illustrative process 350 of FIG. 3B, may be applied to an output of act 610 to compute a frequency distribution over deletion lengths of interest.

The inventors have recognized and appreciated that, while Cas9 is typically understood to induce a blunt-end double-strand break, some evidence suggests that Cas9 may generate a 1 base pair staggered end cut instead. FIG. 7 shows illustrative examples of a blunt-end cut and a staggered cut, in accordance with some embodiments.

Figure 8A:
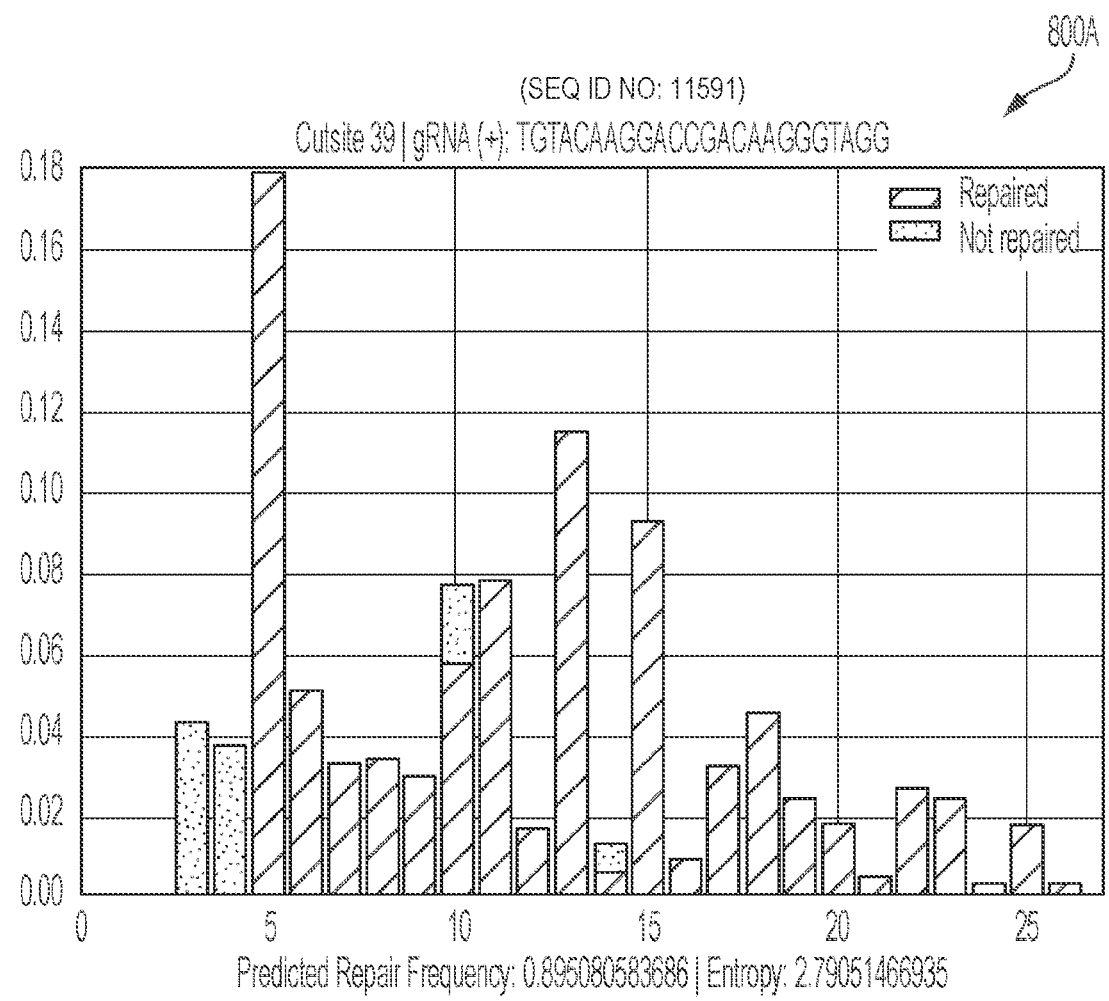
FIG. 8A shows an illustrative plot 800A of predicted repair genotypes, in accordance with some embodiments.

FIG. 8A shows an illustrative plot 800A of predicted repair genotypes, in accordance with some embodiments. For instance, the plot 800A may be generated by applying one or more of the illustrative techniques described in connection with FIGS. 2A-2D, 3A-3B, 4A-4D, 5-6 to the example shown in FIG. 1. Each vertical bar may correspond to a deletion length, and a height of the bar may correspond to a predicted frequency of that deletion length. The lighter color may indicate repair genotypes that successfully eliminate the donor splice site motif, whereas the darker color may indicate failure. In this example, about 90% of repair products in the 3-26 base pair deletion class are predicted to be successful for the illustrative local sequence context and cut site shown in FIG. 1.

The inventors have recognized and appreciated that the 3-26 base pair deletion class may occur as frequently as 50%, for example, when assaying selected sequences (e.g., patient genotypes underlying certain diseases) integrated into the genome of mouse embryonic stem cells, with a 14-day exposure to CRISPR/Cas9. Thus, in view of the 90% success rate predicted above for the 3-26 base pair deletion class, a genetic editing approach using CRISPR-Cas9 may be provided that achieves a desired result with a 45% rate. In contrast, genetic editing using HDR may achieve a success rate of 10% or lower, and may require a more complex experimental protocol.

Figure 8B:
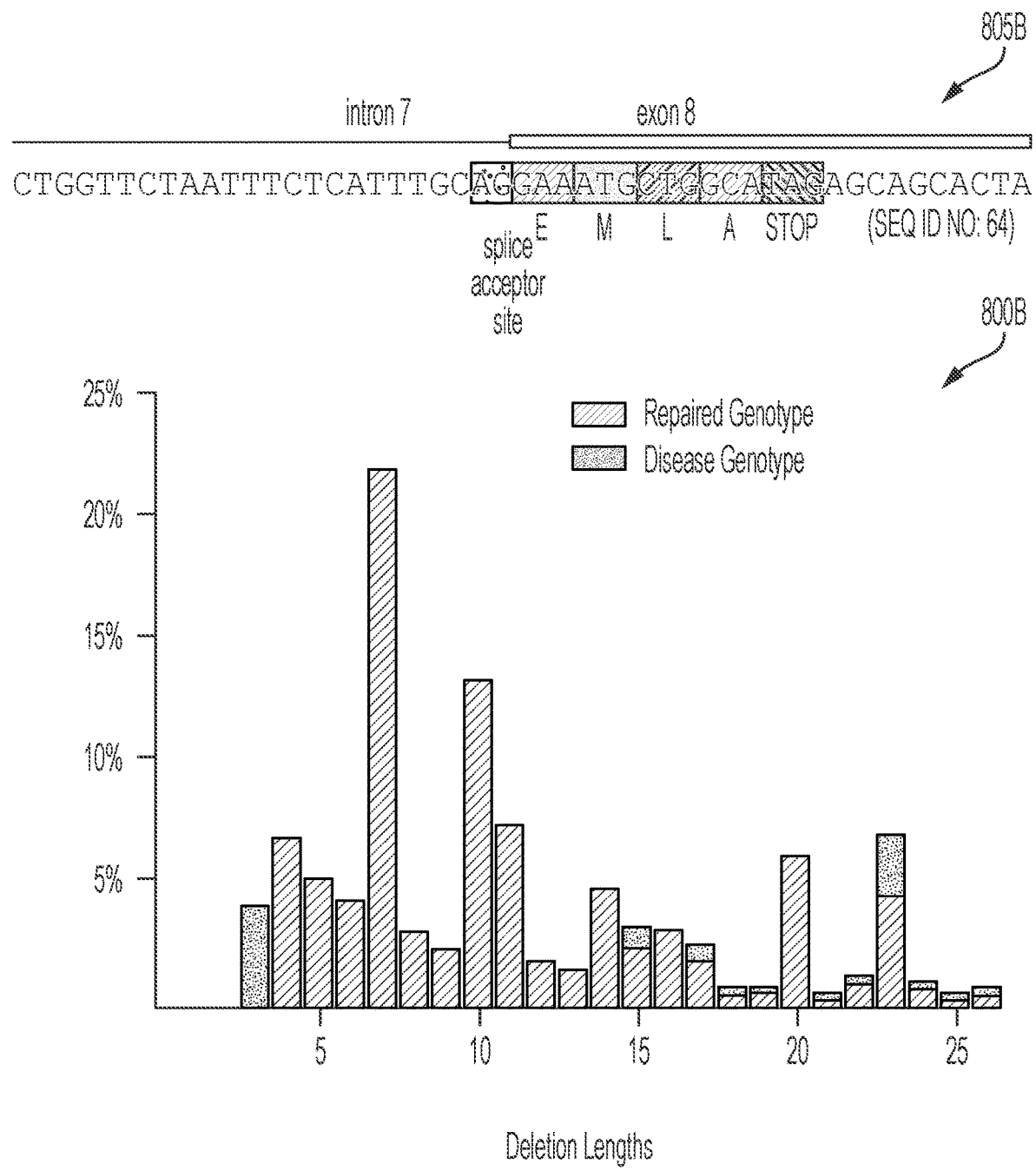
FIG. 8B shows another illustrative plot 800B of predicted repair genotypes, in accordance with some embodiments.

FIG. 8B shows another illustrative plot 800B of predicted repair genotypes, in accordance with some embodiments. For instance, the plot 800B may be generated by applying one or more of the illustrative techniques described in connection with FIGS. 2A-2D, 3A-3B, 4A-4D, 5-6 to an illustrative DNA sequence 805B, which may be associated with spinal muscular atrophy (SMA).

In some patients, a specific single nucleotide polymorphism (SNP) in exon 7 of the SMA2 gene may induce exon skipping of exon 7, erroneously including exon 8 instead. Exon 8 includes a protein degradation signal (namely, EMLA-STOP, as shown in FIG. 8B), which causes degradation in the SMA2 gene product, thereby inducing spinal muscular atrophy. In this region, a disease genotype must have precisely EMLA-STOP. Nearly any other genotype is considered healthy.

In the example of FIG. 8B, each vertical bar corresponds to a deletion length, and a height of the bar corresponds to a predicted frequency of that deletion length. The lighter color may indicate repair genotypes that successfully disrupt the EMLA-STOP signal, whereas the darker color may indicate failure. In this example, over 90% of repair products in the 3-26 base pair deletion class are predicted to be healthy.

Figure 8C:
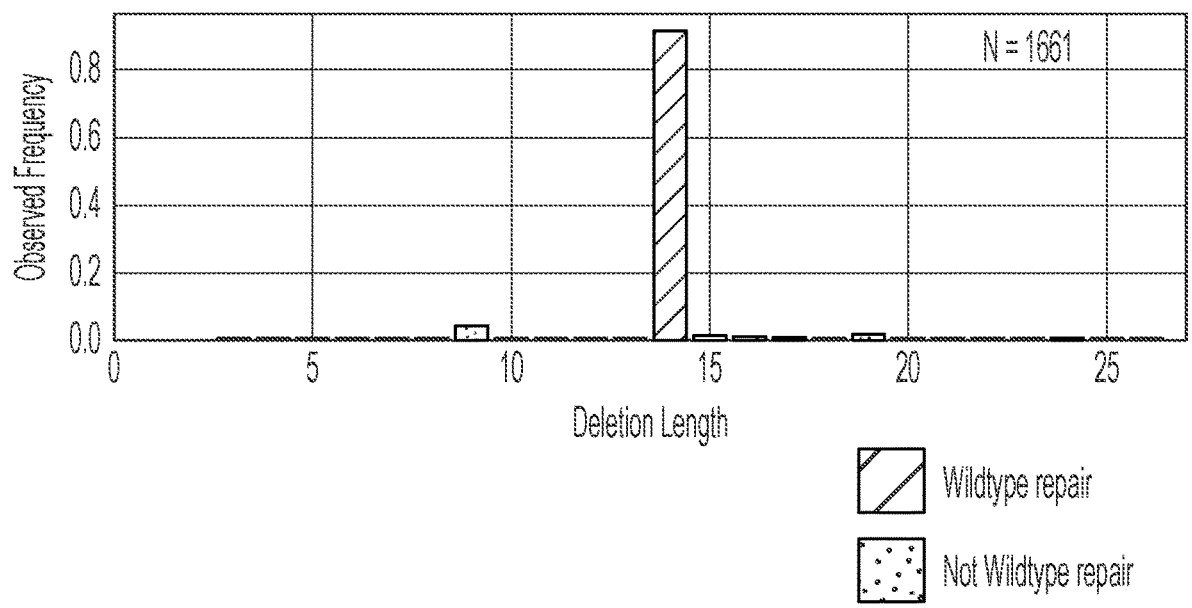
FIG. 8C shows another illustrative plot 800C of predicted repair genotypes, in accordance with some embodiments.

FIG. 8C shows another illustrative plot 800C of predicted repair genotypes, in accordance with some embodiments. For instance, the plot 800C may be generated by applying one or more of the illustrative techniques described in connection with FIGS. 2A-2D, 3A-3B, 4A-4D, 5-6 to an illustrative DNA sequence associated with breast-ovarian cancer.

In the example of FIG. 8C, a clinical observed patient genotype includes an abnormal duplication of 14 base pairs that a wild type sequence from a normal/health individual lacks. The patient genotype is incorporated into the genome of mouse embryonic stem cells, and then CRISPR/Cas9 is applied. It is observed that the 3-26 base pair deletion class occurs 65% out of all repair classes at this local sequence context. Moreover, as shown in FIG. 8C, repair to wild type is observed to occur at 89% rate among all 3-26 base pair deletions. Thus, an overall wild type repair rate is about 57%.

FIG. 8D shows a microhomology identified in the example of FIG. 8C.

As discussed above, the inventors have recognized and appreciated at least two tasks of interest: predicting frequencies of deletion lengths, as well as predicting frequencies of repair genotypes. In some embodiments, a single machine learning model may be provided that performs both tasks.

In some embodiments, repair genotypes corresponding to a deletion of length L may be labeled as follows: for every integer K ranging from 0 to L, a K-genotype associated with deletion length L may be obtained by concatenating left[L][−inf: K] with right[L][K: +inf]. A vector COLLECTION of length Q where each element is a tuple (K, L) may be constructed by enumerating each K-genotype for each deletion length L of interest and removing tuples that have the same repair genotype, e.g., (k', L) and (k, L) such that left[L][−inf: k'] concatenated with right[L][k': +inf] is equivalent to left[L][−inf: k] concatenated with right[L][k: +inf], for example, by retaining only the tuple with the larger K. A training data set may be constructed using observational data by constructing a vector X of length Q where X sums to 1 and X[q] represents an observed frequency of a repair genotype generated by COLLECTION[q].

In some embodiments, the vector COLLECTION may be featurized. This may be performed for a given tuple (k, l) by determining whether there is an index i such that match[l][i: k] is a microhomology. If no such i exists, then the tuple (k, l) may be considered to not partake in microhomology.

The inventors have recognized and appreciated that frequencies of repair products may be influenced by certain features of microhomologies such as microhomology length, fraction of G-C pairings, and/or deletion length. The inventors have also recognized and appreciated that some default values may be useful for repair genotypes that are considered to not partake in microhomology.

For example, the inventors have recognized and appreciated that energetic stability of a microhomology may increase proportionately with a length of the microhomology. Accordingly, in some embodiments, the microhomology length k−i may be used for a tuple (k, l), and a default value of 0 may be used if (k, l) does not partake in microhomology.

As another example, the inventors have recognized and appreciated that thermodynamic stability of a microhomology may depend on specific base pairings, and that G-C pairings have three hydrogen bonds and therefore have higher thermodynamic stability than A-T pairings, which have two hydrogen bonds. Accordingly, in some embodiments, a GC fraction, as shown below, may be used as a feature for (k, l), where indicator(boolean) equals 1 if boolean is true, and 0 otherwise. A default value of −1 may be used if (k, l) does not partake in microhomology.

$$\frac{\sum_{j=1}^{k-1} \text{indicator}(left[l][j] = 'G' \text{ or } 'C')}{k - i}$$

In some embodiments, a feature for deletion length may be considered, represented as l for the tuple (k, l).

The inventors have also recognized and appreciated (e.g., from experimental data) that 0-genotype and 1-genotype repair products may occur despite a lack of microhomology, and may occur through microhomology-free end-joining repair pathways. Accordingly, (k, l) may be featurized with a Boolean for 0-genotype that is equal to 1 if k=0 and (k, l) does not partake in microhomology, and 0 otherwise. A Boolean feature for i-genotypes may also be used where it is equal to 1 if k=l and (k, l) does not partake in microhomology, and 0 otherwise.

Figure 9:
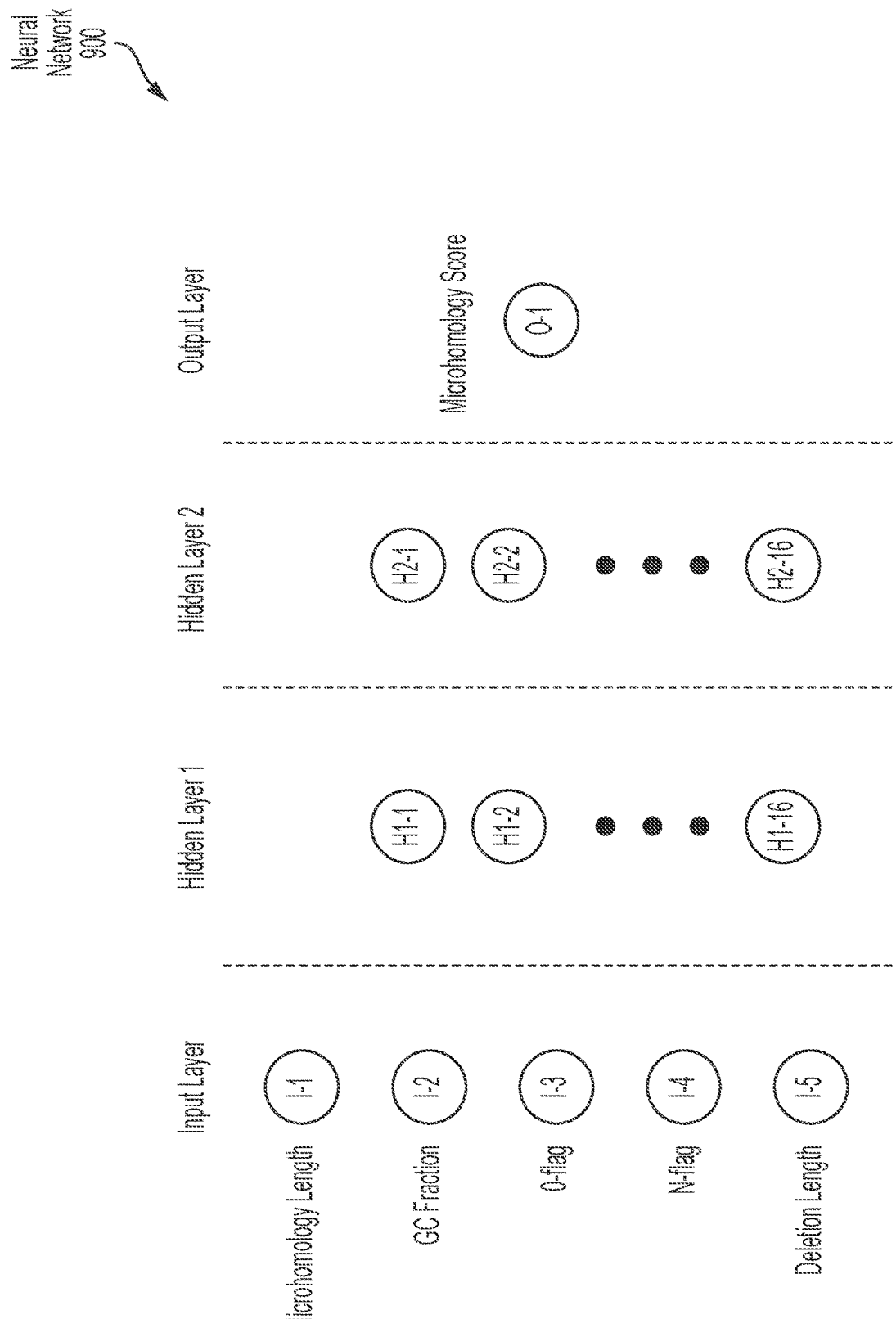
FIG. 9 shows another illustrative neural network 900 for computing a frequency distribution over deletion lengths, in accordance with some embodiments.

FIG. 9 shows another illustrative neural network 900 for computing a frequency distribution over deletion lengths, in accordance with some embodiments.

In some embodiments, the neural network 900 may be parameterized by w[h] and b[h] for each hidden layer h. In some embodiments, these parameters may be initialized randomly, for example, from a spherical Gaussian distribution with some suitable center (e.g., 0) and some suitable variance (e.g., 0.1). These parameters may then be trained using repair genotype data collected from CRISPR/Cas9 experiments.

In some embodiments, the neural network 900 may operate independently for each microhomology, taking as input the length of that microhomology (from the first input node), the GC fraction of that microhomology (from the second input node), Boolean features for 0 and 1-genotypes (from the third and fourth input node, where N-flag corresponds to i-genotypes), and the length of the deletion (from the fifth input node), transforming those five values into 16 values (at the first hidden layer), then transforming those 16 values into 16 other values (at the second hidden layer), and finally outputting a single value (at the output node). In such an embodiment, parameters for the first hidden layer, w[1][i] and b[1][i], are vectors of length 5 for each node i from 1 to 16, whereas parameters for the second hidden layer, w[2][i] and b[2][i], are vectors of length 16 for each node i from 1 to 16, and parameters for the output layer, w[3][1] and b[3][1], are also vectors of length 16.

In some embodiments, the neural network 900 may be applied independently (e.g., as discussed above) to each featurized (k, l) in COLLECTIONS to produce a vector of Q microhomology scores called Z.

In some embodiments, Z may be normalized into a probability distribution over all unique repair genotypes of interest within all deletion lengths of interest (e.g., deletion lengths between 3 and 26). The inventors have recognized and appreciated (e.g., from experimental data) that frequency may decrease exponentially with deletion length. Accordingly, in some embodiments, an exponential linear model may be used to normalize the vector of repair genotype scores. For example, the following formula may be used:

$$Y[q] = \frac{\exp(Z[q] - \text{beta} * DL[q])}{\sum_{q'=1}^{Q} \exp(Z[q'] - \text{beta} * DL[q'])}$$

where DL[q]=l for each q where COLLECTIONS[q]=(k, l), and beta is a parameter. In some embodiments, a probability distribution Y over all unique repair genotypes of interest within all deletion lengths of interest may be converted to a probability distribution Y' over all deletion lengths. The following formula may be used for this:

$$Y'[l] = \frac{\sum_{q=1}^{Q} Y[q] * \text{indicator}(DL[q] = l)}{\sum_{q=1}^{Q} Y[q]}$$

In some embodiments, the parameter beta may be initialized to −1. These parameters may then be trained using repair genotype data collected from CRISPR/Cas9 experiments.

In some embodiments, the parameters w[h] and b[h] for each hidden layer h and the parameters beta may be trained by using a gradient descent method with L2-loss on Y:

$$L(\text{predY}, \text{obsY}) = \|\text{predY} - \text{obsY}\|_2^2,$$

where predY is a predicted probability distribution on deletion lengths (e.g., as computed by the neural network 900 using current parameter values), and obsY is an observed probability distribution on deletion lengths (e.g., based on repair genotype data collected from CRISPR/Cas9 experiments).

The inventors have recognized and appreciated that one or more of the techniques described herein may be used to identify therapeutic guide RNAs that are expected to produce a therapeutic outcome when used in combination with a genomic editing system without an HDR template. For instance, one or more of the techniques described herein may be used to identify a therapeutic guide RNA that is expected to result in a substantial fraction of genotypic consequences that cause a gain-of-function mutation in DNA in the absence of an HDR template. A therapeutic guide RNA may be used singly, or in combination with other therapeutic guide RNAs. An action of the therapeutic guide RNA may be independent of, or dependent on, one or more genomic consequences of the other therapeutic guide RNAs.

Figure 10:
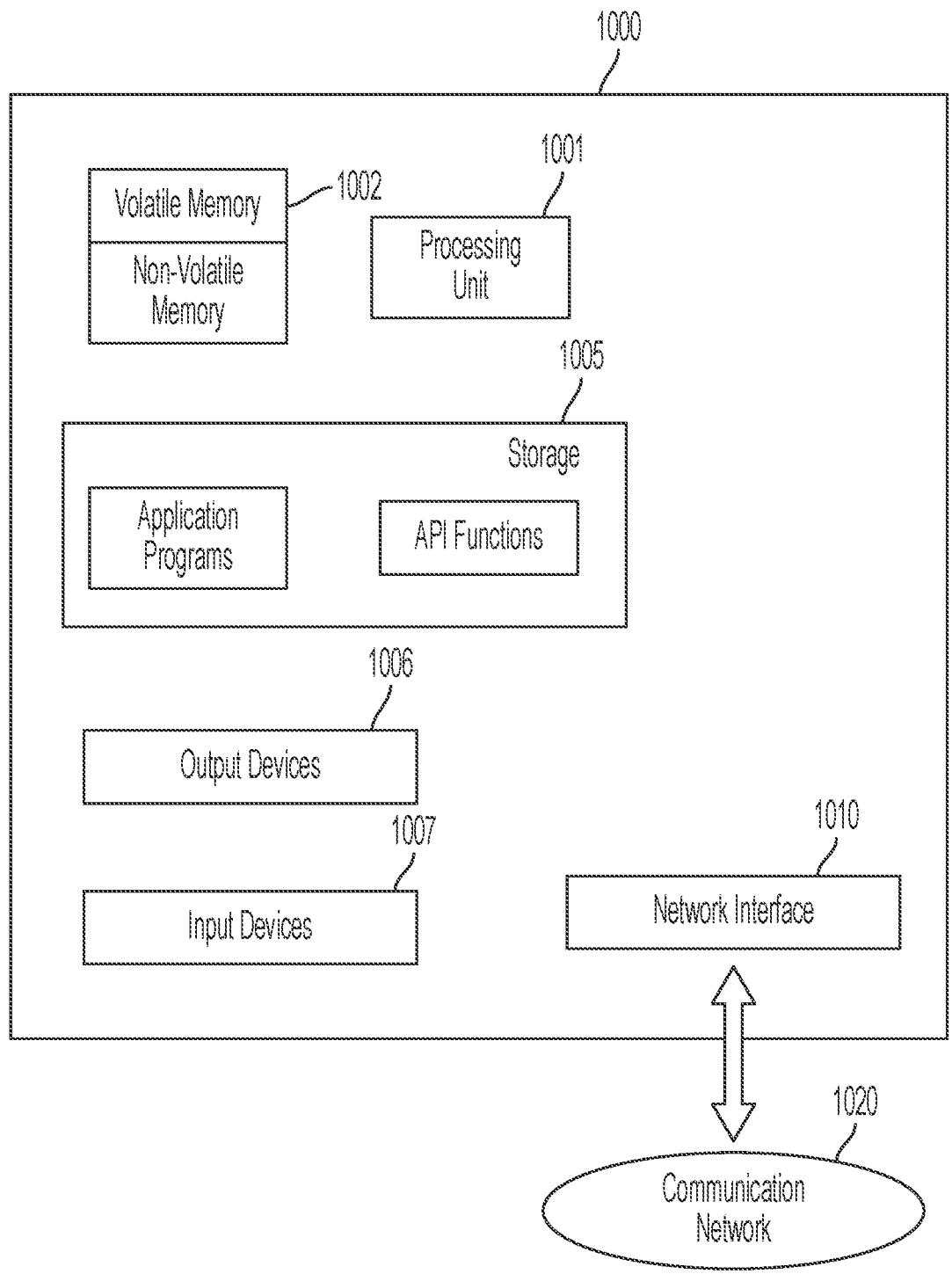
FIG. 10 shows, schematically, an illustrative computer 1000 on which any aspect of the present disclosure may be implemented.

FIG. 10 shows, schematically, an illustrative computer 1000 on which any aspect of the present disclosure may be implemented. In the embodiment shown in FIG. 10, the computer 1000 includes a processing unit 1001 having one or more processors and a non-transitory computer-readable storage medium 1002 that may include, for example, volatile and/or non-volatile memory. The memory 1002 may store one or more instructions to program the processing unit 1001 to perform any of the functions described herein. The computer 1000 may also include other types of non-transitory computer-readable medium, such as storage 1005 (e.g., one or more disk drives) in addition to the system memory 1002. The storage 1005 may also store one or more application programs and/or external components used by application programs (e.g., software libraries), which may be loaded into the memory 1002.

The computer 1000 may have one or more input devices and/or output devices, such as devices 1006 and 1007 illustrated in FIG. 10. These devices can be used, among other things, to present a user interface. Examples of output devices that can be used to provide a user interface include printers or display screens for visual presentation of output and speakers or other sound generating devices for audible presentation of output. Examples of input devices that can be used for a user interface include keyboards and pointing devices, such as mice, touch pads, and digitizing tablets. As another example, the input devices 1007 may include a microphone for capturing audio signals, and the output devices 1006 may include a display screen for visually rendering, and/or a speaker for audibly rendering, recognized text.

As shown in FIG. 10, the computer 1000 may also comprise one or more network interfaces (e.g., the network interface 1010) to enable communication via various networks (e.g., the network 1020). Examples of networks include a local area network or a wide area network, such as an enterprise network or the Internet. Such networks may be based on any suitable technology and may operate according to any suitable protocol and may include wireless networks, wired networks or fiber optic networks.

Having thus described several aspects of at least one embodiment, it is to be appreciated that various alterations, modifications, and improvements will readily occur to those skilled in the art. Such alterations, modifications, and improvements are intended to be within the spirit and scope of the present disclosure. Accordingly, the foregoing description and drawings are by way of example only.

The above-described embodiments of the present disclosure can be implemented in any of numerous ways. For example, the embodiments may be implemented using hardware, software or a combination thereof. When implemented in software, the software code can be executed on any suitable processor or collection of processors, whether provided in a single computer or distributed among multiple computers.

Also, the various methods or processes outlined herein may be coded as software that is executable on one or more processors that employ any one of a variety of operating systems or platforms. Additionally, such software may be written using any of a number of suitable programming languages and/or programming or scripting tools, and also may be compiled as executable machine language code or intermediate code that is executed on a framework or virtual machine.

In this respect, the concepts disclosed herein may be embodied as a non-transitory computer-readable medium (or multiple computer-readable media) (e.g., a computer memory, one or more floppy discs, compact discs, optical discs, magnetic tapes, flash memories, circuit configurations in Field Programmable Gate Arrays or other semiconductor devices, or other non-transitory, tangible computer storage medium) encoded with one or more programs that, when executed on one or more computers or other processors, perform methods that implement the various embodiments of the present disclosure discussed above. The computer-readable medium or media can be transportable, such that the program or programs stored thereon can be loaded onto one or more different computers or other processors to implement various aspects of the present disclosure as discussed above.

The terms "program" or "software" are used herein to refer to any type of computer code or set of computer-executable instructions that can be employed to program a computer or other processor to implement various aspects of the present disclosure as discussed above. Additionally, it should be appreciated that according to one aspect of this embodiment, one or more computer programs that when executed perform methods of the present disclosure need not reside on a single computer or processor, but may be distributed in a modular fashion amongst a number of different computers or processors to implement various aspects of the present disclosure.

Computer-executable instructions may be in many forms, such as program modules, executed by one or more computers or other devices. Generally, program modules include routines, programs, objects, components, data structures, etc. that perform particular tasks or implement particular abstract data types. Typically the functionality of the program modules may be combined or distributed as desired in various embodiments.

Also, data structures may be stored in computer-readable media in any suitable form. For simplicity of illustration, data structures may be shown to have fields that are related through location in the data structure. Such relationships may likewise be achieved by assigning storage for the fields with locations in a computer-readable medium that conveys relationship between the fields. However, any suitable mechanism may be used to establish a relationship between information in fields of a data structure, including through the use of pointers, tags or other mechanisms that establish relationship between data elements.

Various features and aspects of the present disclosure may be used alone, in any combination of two or more, or in a variety of arrangements not specifically discussed in the embodiments described in the foregoing and is therefore not limited in its application to the details and arrangement of components set forth in the foregoing description or illustrated in the drawings. For example, aspects described in one embodiment may be combined in any manner with aspects described in other embodiments.

In an exemplary embodiment, a computational model described herein is trained with experimental data as outlined in Example 1. The method outlined in Example 1 for training a computational model with experimental data is meant to be non-limiting.

Accordingly, the specification discloses a method for training a computational model described herein, comprising: (i) preparing a library comprising a plurality of nucleic acid molecules each encoding a nucleotide target sequence and a cognate guide RNA, wherein each nucleotide target sequence comprises a cut site; (ii) introducing the library into a plurality of host cells; (iii) contacting the library in the host cells with a Cas-based genome editing system to produce a plurality of genomic repair products; (iv) determining the sequences of the genomic repair products; and (iv) training the computational model with input data that comprises at least the sequences of the nucleotide target sequence and/or the genomic repair products and the cut sites.

In another aspect, the specification discloses a method for training a computational model, comprising: (i) preparing a library comprising a plurality of nucleic acid molecules each encoding a nucleotide target sequence and a cut site; (ii) introducing the library into a plurality of host cells; (iii) contacting the library in the host cells with a DSB-based genome editing system to produce a plurality of genomic repair products; (iv) determining the sequences of the genomic repair products; and (iv) training the computational model with input data that comprises at least the sequences of the nucleotide target sequence and/or the genomic repair products and the cut sites.

Methods for preparing nucleic acid libraries, vectors, host cells, and sequencing methods are well known in the art. The instant description is not meant to be limiting in any way as to the construction and configuration of the libraries described herein for training the computational model.

Accordingly, the specification provides in one aspect a method of introducing a desired genetic change in a nucleotide sequence using a double-strand brake (DSB)-inducing genome editing system, the method comprising: identifying one or more available cut sites in a nucleotide sequence; analyzing the nucleotide sequence and available cut sites with a computational model to identify the optimal cut site for introducing the desired genetic change into the nucleotide sequence; and contacting the nucleotide sequence with a DSB-inducing genome editing system, thereby introducing the desired genetic change in the nucleotide sequence at the cut site.

A cut site can be at any position in a nucleotide sequence and its position is not particularly limiting.

The nucleotide sequence into which a genetic change is desired is not intended to have any limitations as to sequence, source, or length. The nucleotide sequence may comprise one or more mutations, which can include one or more disease-causing mutations.

In another aspect, the specification provides a method of treating a genetic disease by correcting a disease-causing mutation using a double-strand brake (DSB)-inducing genome editing system, the method comprising: identifying one or more available cut sites in a nucleotide sequence comprising a disease-causing mutation; analyzing the nucleotide sequence and available cut sites with a computational model to identify the optimal cut site for correcting the disease-causing mutation in the nucleotide sequence; and contacting the nucleotide sequence with a DSB-inducing genome editing system, thereby correcting the disease-causing mutation and treating the disease.

In yet another aspect, the specification provides a method of altering a genetic trait by introducing a genetic change in a nucleotide sequence using a double-strand brake (DSB)-inducing genome editing system, the method comprising: identifying one or more available cut sites in a nucleotide sequence; analyzing the nucleotide sequence and available cut sites with a computational model to identify the optimal cut site for introducing the genetic change into the nucleotide sequence; and contacting the nucleotide sequence with a DSB-inducing genome editing system, thereby introducing the desired genetic change in the nucleotide sequence at the cut site and consequently altering the associated genetic trait.

In another aspect, the specification provides a method of selecting a guide RNA for use in a Cas-genome editing system capable of introducing a genetic change into a nucleotide sequence of a target genomic location, the method comprising: identifying in a nucleotide sequence of a target genomic location one or more available cut sites for a Cas-based genome editing system; and analyzing the nucleotide sequence and cut site with a computational model to identify a guide RNA capable of introducing the genetic change into the nucleotide sequence of the target genomic location.

In still another aspect, the specification provides a method of introducing a genetic change in the genome of a cell with a Cas-based genome editing system comprising: selecting a guide RNA for use in the Cas-based genome editing system in accordance with the method of the above aspect; and contacting the genome of the cell with the guide RNA and the Cas-based genome editing system, thereby introducing the genetic change.

In various embodiments, the cut sites available in the nucleotide sequence are a function of the particular DSB-inducing genome editing system in use, e.g., a Cas-based genome editing system.

In certain embodiments, the nucleotide sequence is a genome of a cell.

In certain other embodiments, the method for introducing the desired genetic change is done in vivo within a cell or an organism (e.g., a mammal), or ex vivo within a cell isolated or separated from an organism (e.g., an isolated mammalian cancer cell), or in vitro on an isolated nucleotide sequence outside the context of a cell.

In various embodiments, the DSB-inducing genome editing system can be a Cas-based genoe editing system, e.g., a type II Cas-based genome editing system. In other embodiments, the DSB-inducing genome editing system can be a TALENS-based editing system or a Zinc-Finger-based genome editing system. In still other embodiments, the DSB-inducing genome editing system can be any such endonuclease-based system which catalyzes the formation of a double-strand break at a specific one or more cut sites.

In embodiments involving a Cas-based genome editing system, the method can further comprise selecting a cognate guide RNA capable of directing a double-strand break at the optimal cut site by the Cas-based genome editing system.

In certain embodiments, the guide RNA is selected from the group consisting the guide RNA sequences listed in any of Tables 1-6. In various embodiments, the guide RNA can be known or can be newly designed.

In various embodiments, the double-strand brake (DSB)-inducing genome editing system is capable of editing the genome without homology-directed repair.

In other embodiments, the double-strand brake (DSB)-inducing genome editing system comprises a type I Cas RNA-guided endonuclease, or a variant or orthologue thereof.

In still other embodiments, the double-strand brake (DSB)-inducing genome editing system comprises a type II Cas RNA-guided endonuclease, or a functional variant or orthologue thereof.

The double-strand brake (DSB)-inducing genome editing system may comprise a Cas9 RNA-guided endonuclease, or a variant or orthologue thereof in certain embodiments.

In still other embodiments, the double-strand brake (DSB)-inducing genome editing system can comprise a Cpf1 RNA-guided endonuclease, or a variant or orthologue thereof.

In yet further embodiments, the double-strand brake (DSB)-inducing genome editing system can comprise a *Streptococcus pyogenes* Cas9 (SpCas9), *Staphylococcus pyogenes* Cas9 (SpCas9), *Staphyloccocus aureus* Cas (SaCas9), *Francisella novicida* Cas9 (FnCas9), or a functional variant or orthologue thereof.

In various embodiments, the desired genetic change to be introduced into the nucleotide sequence, e.g., a genome, is to a correction to a genetic mutation. In embodiments, the genetic mutation is a single-nucleotide polymorphism, a deletion mutation, an insertion mutation, or a microduplication error.

In still other embodiments, the genetic change can comprises a 2-60-bp deletion or a 1-bp insertion.

The genetic change in other embodiments can comprise a deletion of between 2-20, or 4-40, or 8-80, or 16-160, or 32-320, 64-640, or up to 1000, 2000, 3000, 4000, 5000, 6000, 7000, 8000, 9000, or 10,000 or more nucleotides. Preferably, the deletion can restore the function of a defective gene, e.g., a gain-of-function frameshift genetic change.

In other embodiments, the desired genetic change is a desired modification to a wildtype gene that confers and/or alters one or more traits, e.g., conferring increased resistance to a pathogen or altering a monogenic trait (e.g., eye color) or polygenic trait (e.g., height or weight).

In embodiments involving correcting a disease-causing mutation, the disease can be a monogenic disease. Such monogenic diseases can include, for example, sickle cell disease, cystic fibrosis, polycystic kidney disease, Tay-Sachs disease, achondroplasia, beta-thalassemia, Hurler syndrome, severe combined immunodeficiency, hemophilia, glycogen storage disease Ia, and Duchenne muscular dystrophy.

In any of the above aspects and embodiments, the step of identifying the available cut sites can involve identifying one or more PAM sequences in the case of a Cas-based genome editing system.

In various embodiments of the above methods, the computational model used to analyze the nucleotide sequence is a deep learning computational model, or a neural network model having one or more hidden layers. In various embodiments, the computational model is trained with experimental data to predict the probability of distribution of indel lengths for any given nucleotide sequence and cut site. In still other embodiments, the computational model is trained with experimental data to predict the probability of distribution of genotype frequencies for any given nucleotide sequence and cut site.

In various embodiments, the computational model comprises one or more training modules for evaluating experimental data.

In various embodiments, the computational model can comprise: a first training module for computing a microhomology score matrix; a second training module for computing a microhomology independent score matrix; and a third training module for computing a probability distribution over 1-bp insertions, wherein once trained with experimental data the computational model computes a probability distribution over indel genotypes and a probability distribution over indel lengths for any given input nucleotide sequence and cut site.

In other embodiments, the computational model predicts genomic repair outcomes for any given input nucleotide sequence and cut site.

In various embodiments, the genomic repair outcomes can comprise microhomology deletions, microhomology-less deletions, and/or 1-bp insertions.

In still other embodiments, the computational model can comprise one or more modules each comprising one more input features selected from the group consisting of: a target site nucleotide sequence; a cut site; a PAM-sequence; microhomology lengths relative at a cut site, % GC content at a cut site; and microhomology deletion lengths at a cut site, and type of DSB-genome editing system.

In various embodiments, the nucleotide sequence analyzed by the computational model is between about 25-100 nucleotides, 50-200 nucleotides, 100-400 nucleotides, 200-800 nucleotides, 400-1600 nucleotides, 800-3200 nucleotides, and 1600-6400 nucleotide, or even up to 7K, 8K, 9K, 10K, 11K, 12K, 13K, 14K, 15K, 16K, 17K, 18K, 19K, 20K nucleotides, or more in length.

In another aspect, the specification relates to guide RNAs which are identified by various methods described herein. In certain embodiments, the guide RNAs can be any of those presented in Tables 1-6, the contents of which form part of this specification.

According to various embodiments, the RNA can be purely ribonucleic acid molecules. However, in other embodiments, the RNA guides can comprise one or more naturally-occurring or non-naturally occurring modifications. In various embodiments, the modifications can including, but are not limited to, nucleoside analogs, chemically modified bases, intercalated bases, modified sugars, and modified phosphate group linkers. In certain embodiments, the guide RNAs can comprise one or more phosphorothioate and/or 5'-N-phosphporamidite linkages.

In still other aspects, the specification discloses vectors comprising one or more nucleotide sequences disclosed herein, e.g., vectors encoding one or more guide RNAs, one or more target nucleotide sequences which are being edited, or a combination thereof. The vectors may comprise naturally occurring sequences, or non-naturally occurring sequences, or a combination thereof.

In still other aspects, the specification discloses host cells comprising the herein disclosed vectors encoding one more more nucleotide sequences embodied herein, e.g., one or more guide RNAs, one or more target nucleotide sequences which are being edited, or a combination thereof.

In other aspects, the specification discloses a Cas-based genome editing system comprising a Cas protein (or homolog, variant, or orthologue thereof) complexed with at least one guide RNA. In certain embodiments, the guide RNA can be any of those disclosed in Tables 1-6, or a functional variant thereof.

In still other aspects, the specification provides a Cas-based genome editing system comprising an expression vector having at least one expressible nucleotide sequence encoding a Cas protein (or homolog, variant, or orthologue thereof) and at least one other expressible nucleotide sequence encoding a guide RNA, wherein the guide RNA can be identified by the methods disclosed herein for selecting a guide RNA.

In yet another aspect, the specification provides a Cas-based genome editing system comprising an expression vector having at least one expressible nucleotide sequence encoding a Cas protein (or homolog, variant, or orthologue thereof) and at least one other expressible nucleotide sequence encoding a guide RNA, wherein the guide RNA can be identified by the methods disclosed herein for selecting a guide RNA.

In still a further aspect, the specification provides a library for training a computational model for selecting a guide RNA sequence for use with a Cas-based genome editing system capable of introducing a genetic change into a genome without homology-directed repair, wherein the library comprises a plurality of vectors each comprising a first nucleotide sequence of a target genomic location having a cut site and a second nucleotide sequence encoding a cognate guide RNA capable of directing a Cas-based genome editing system to carry out a double-strand break at the cut site of the first nucleotide sequence.

In another aspect, the specification provides a library and its use for training a computational model for selecting an optimized cut site for use with a DSB-based genome editing system (e.g., Cas-based system, TALAN-based system, or a Zinc-Finger-based system) that is capable of introducing a desired genetic change into a nucleotide sequence (e.g., a genome) at the selected cut site without homology-directed repair, wherein the library comprises a plurality of vectors each comprising a nucleotide sequence having a cut site, and optionally a second nucleotide sequence encoding a cognate guide RNA (in embodiments involving a Cas-based genome editing system).

Also, the concepts disclosed herein may be embodied as a method, of which an example has been provided. The acts performed as part of the method may be ordered in any suitable way. Accordingly, embodiments may be constructed in which acts are performed in an order different than illustrated, which may include performing some acts simultaneously, even though shown as sequential acts in illustrative embodiments.

EXAMPLES

In order that the invention described herein may be more fully understood, the following examples are set forth. It should be understood that these examples are for illustrative purposes only and are not to be construed as limiting this invention in any manner.

Example 1: Demonstration of Predictable and Precise Template-Free CRISPR Editing of Pathogtenic Variants

SUMMARY

DNA double-strand break repair following cleavage by Cas9 is generally considered stochastic, heterogeneous, and impractical for applications beyond gene disruption. Here, it is shown that template-free Cas9 nuclease-mediated DNA repair is predictable in human and mouse cells and is capable of precise repair to a predicted genotype in certain sequence contexts, enabling correction of human disease-associated mutations. A genomically integrated library of guide RNAs (gRNAs) was constructed, each paired with its corresponding DNA target sequence, and trained a machine learning model, inDelphi, on the end-joining repair products of 1,095 sequences cleaved by Cas9 nuclease in mammalian cells. The resulting model accurately predicted frequencies of 1- to 60-bp deletions and 1-bp insertions (median r=0.87) with single-base resolution at 194 held-out library sites and ~90 held-out endogenous sequence contexts in four human and mouse cell lines. The inDelphi model predicts that 26% of all *Streptococcus pyogenes* Cas9 (SpCas9) gRNAs targeting the human genome result in outcomes in which a single predictable product accounts for ≥30% of all edited products, while 5% of gRNAs are "high-precision guides" that result in repair outcomes in which one product accounts for ≥50% of all edited products. It was experimentally confirmed that 183 human disease-associated microduplication alleles can each be corrected to their wild-type genotypes with ≥50% frequency among edited products following Cas9 cleavage in mammalian cells. Using these insights, genotypic and functional rescue of pathogenic LDLR microduplication alleles was achieved in human and mouse cells, and restored to wild-type an endogenous genomic Hermansky-Pudlak syndrome (HPS1) pathogenic allele in primary patient-derived fibroblasts. This study establishes that template-free Cas9 nuclease activity can be harnessed for precise genome editing applications.

More in particular, this study developed a high-throughput *Streptococcus pyogenes* Cas9 (SpCas9)-mediated repair outcome assay to characterize end-joining repair products at Cas9-induced double-stranded breaks using 1,872 target sites based on sequence characteristics of the human genome. The study used the resulting rich set of repair product data to train the herein disclosed machine-learning algorithm (i.e., inDelphi), which accurately predicts the frequencies of the substantial majority of template-free Cas9-induced insertion and deletion events at single-base resolution (which is further described in M. Shen et al., "Predictable and precise template-free CRISPR editing of pathogenic variants," Nature, vol. 563, Nov. 29, 2018, pp. 646-651, and including Extended Data). This study finds that in contrast to the notion that end-joining repair is heterogeneous, inDelphi identifies that 5-11% of SpCas9 gRNAs in the human genome induce a single predictable repair genotype in ≥50% of editing products.

Building on this idea of precision gRNAs, this study further uses inDelphi to design 14 gRNAs for high-precision template-free editing yielding predictable 1-bp insertion genotypes in endogenous human disease-relevant loci and experimentally confirmed highly precise editing (median 61% among edited products) in two human cell lines. As described herein, inDelphi was used to reveal human pathogenic alleles that are candidates for efficient and precise template-free gain-of-function genotypic correction and achieved template-free correction of 183 pathogenic human microduplication alleles to the wild-type genotype in ≥50% of all editing products. Finally, these developments were integrated to achieve high-precision correction of five pathogenic low-density lipoprotein receptor (LDLR) microduplication alleles in human and mouse cells, as well as correction of endogenous pathogenic microduplication alleles for Hermansky-Pudlak syndrome (HPS1) and Menkes disease (ATP7A) to the wild-type sequence in primary patient-derived fibroblasts.

Results

Cas9-Mediated DNA Repair Products are Predictable

Figure 11A:
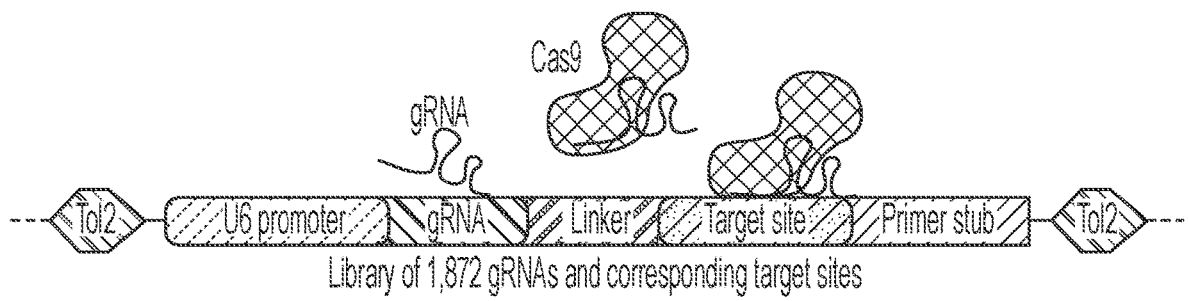
FIGS. 11A-11C show a high-throughput assessment of Cas9-mediated DNA repair products.
Figure 16A:
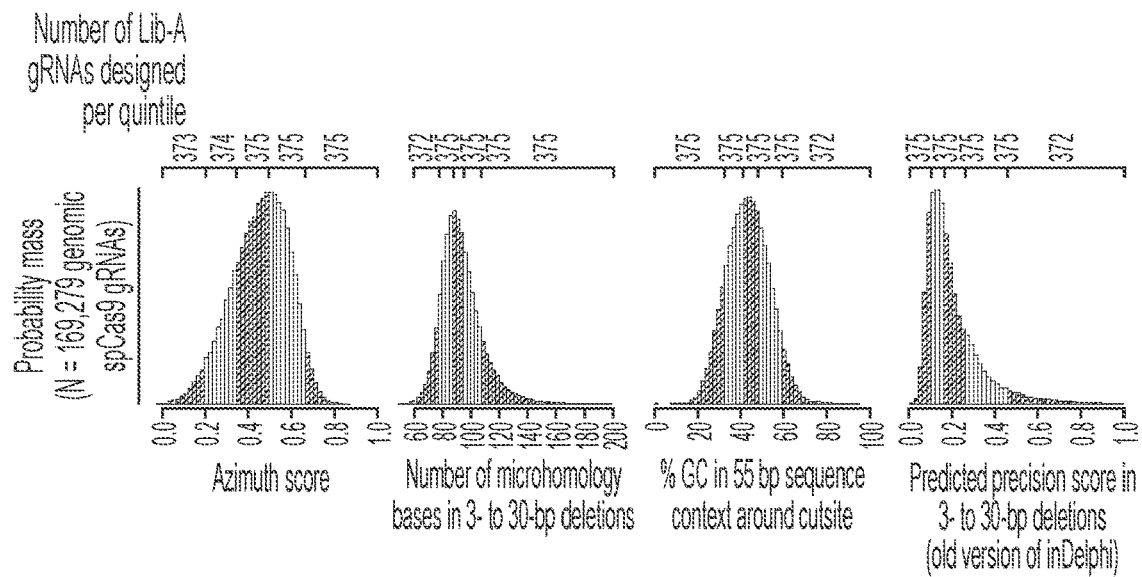
Figure 16B:
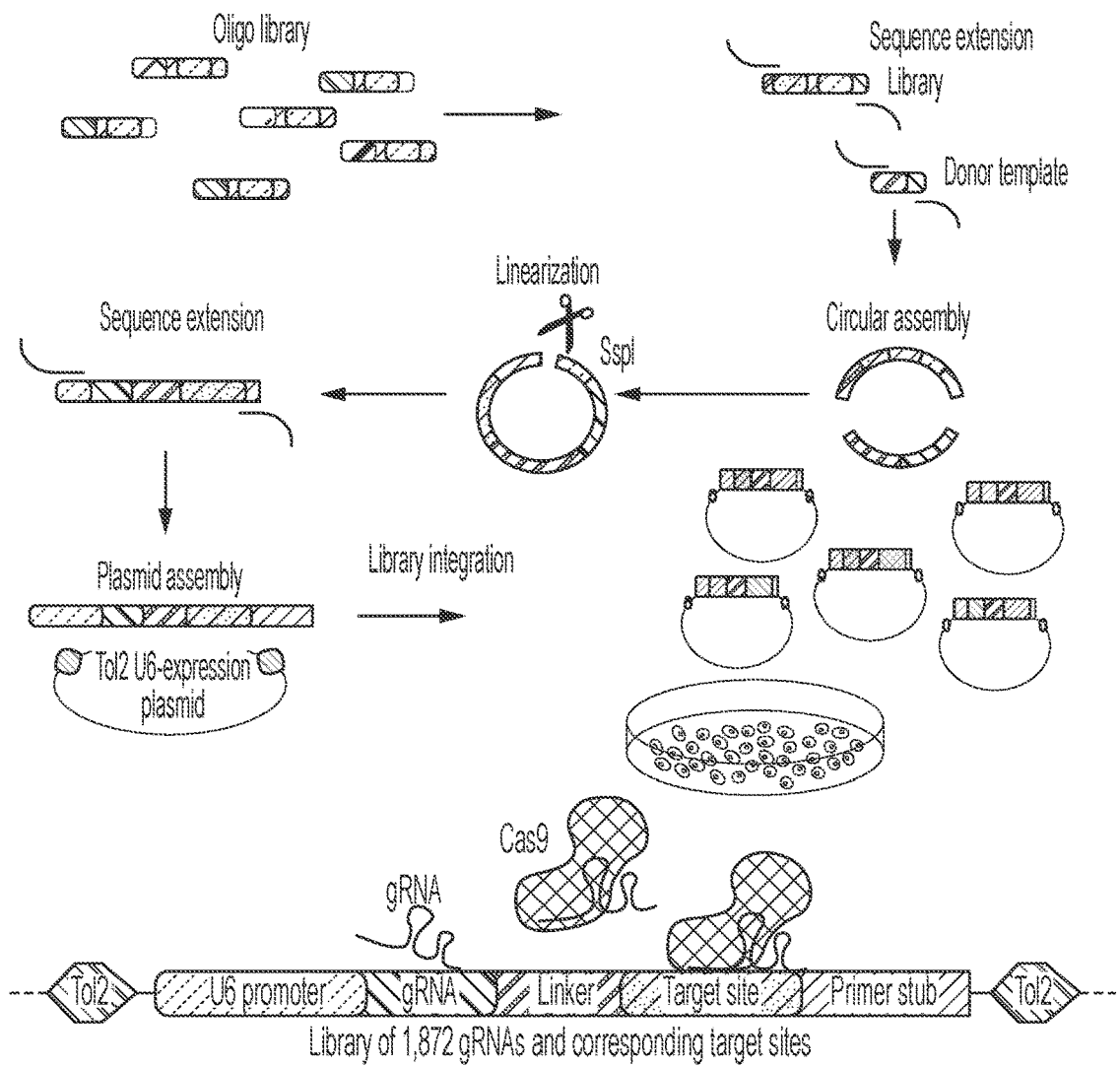
Figure 16C:
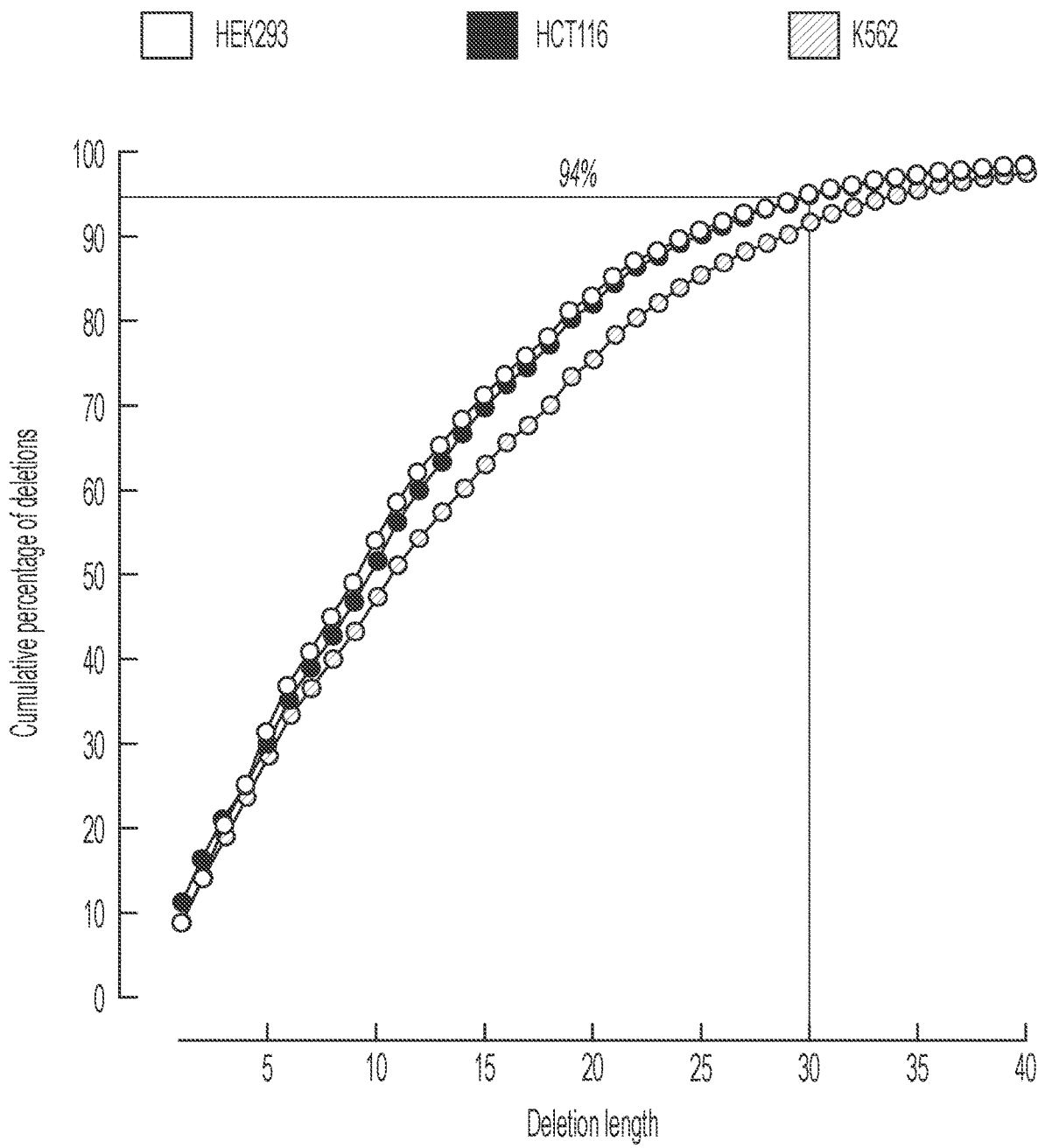
Figure 16D:
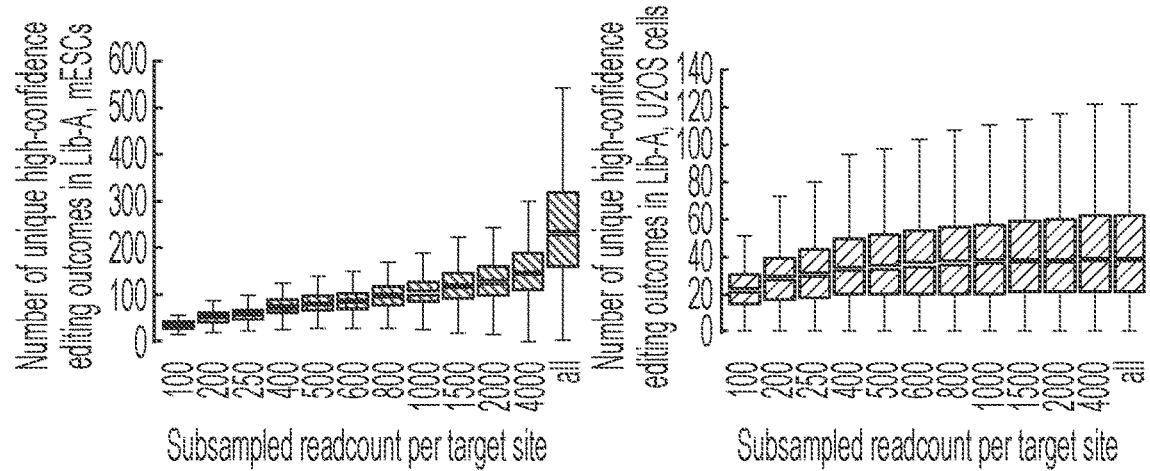
Figure 16E:
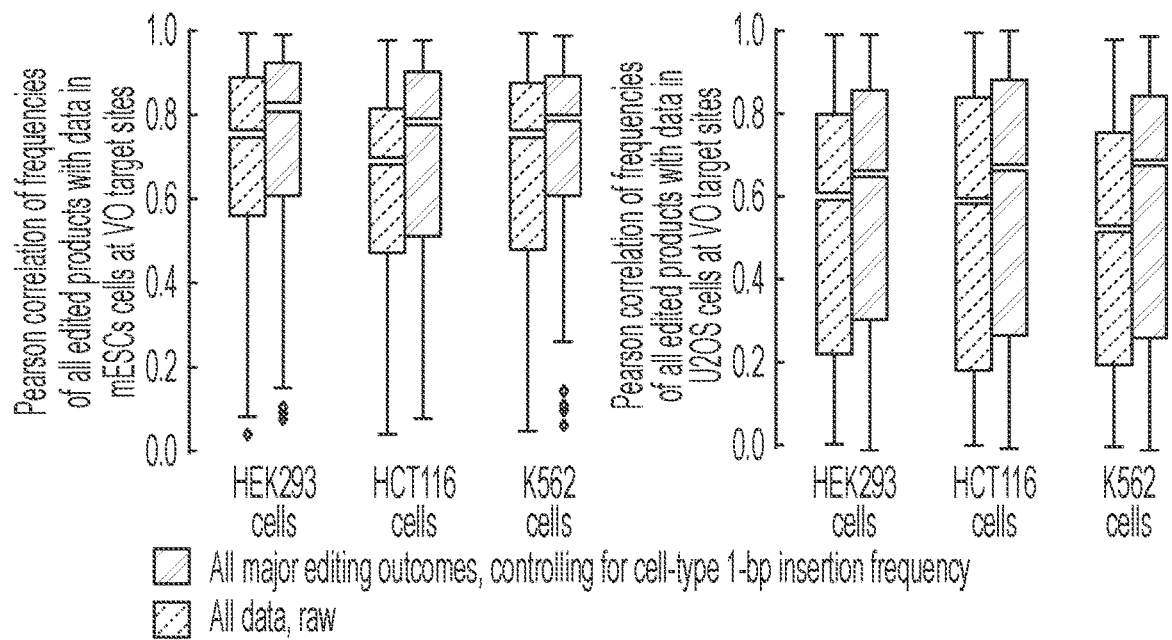
Figure 17A:
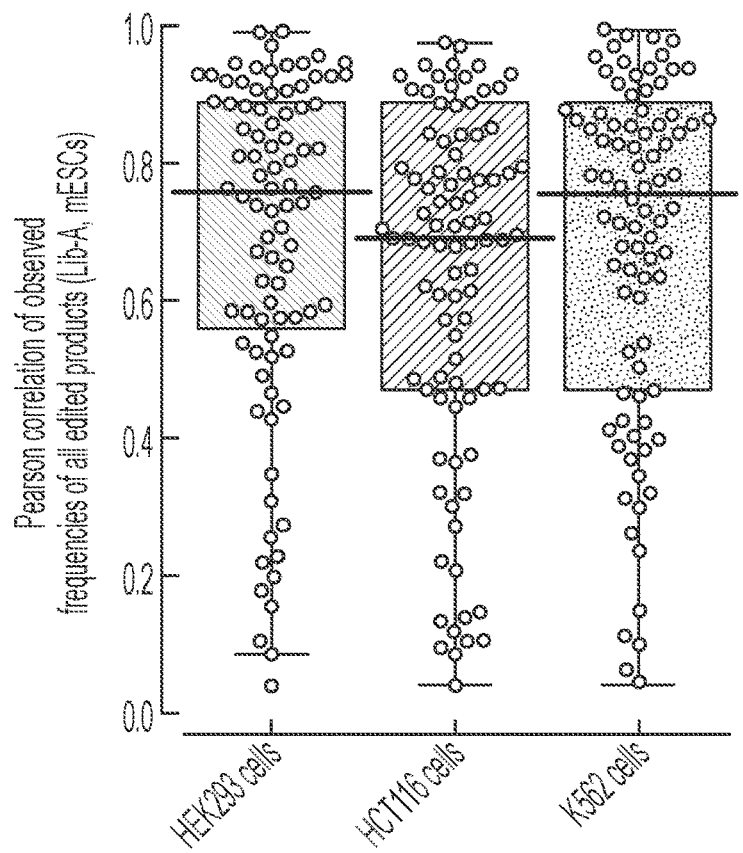
Figure 17B:
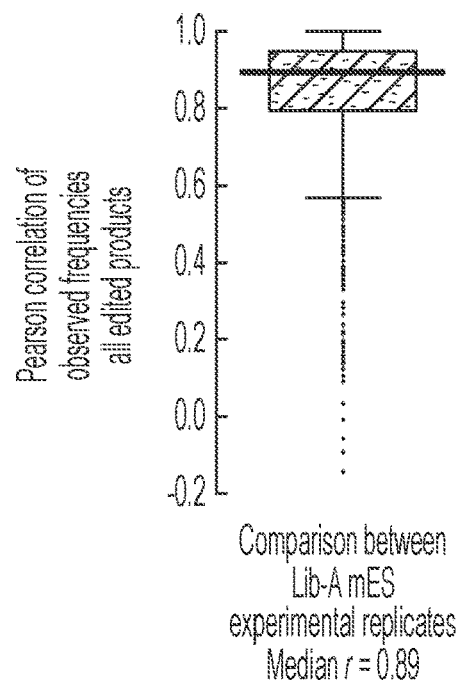
Figure 17C:
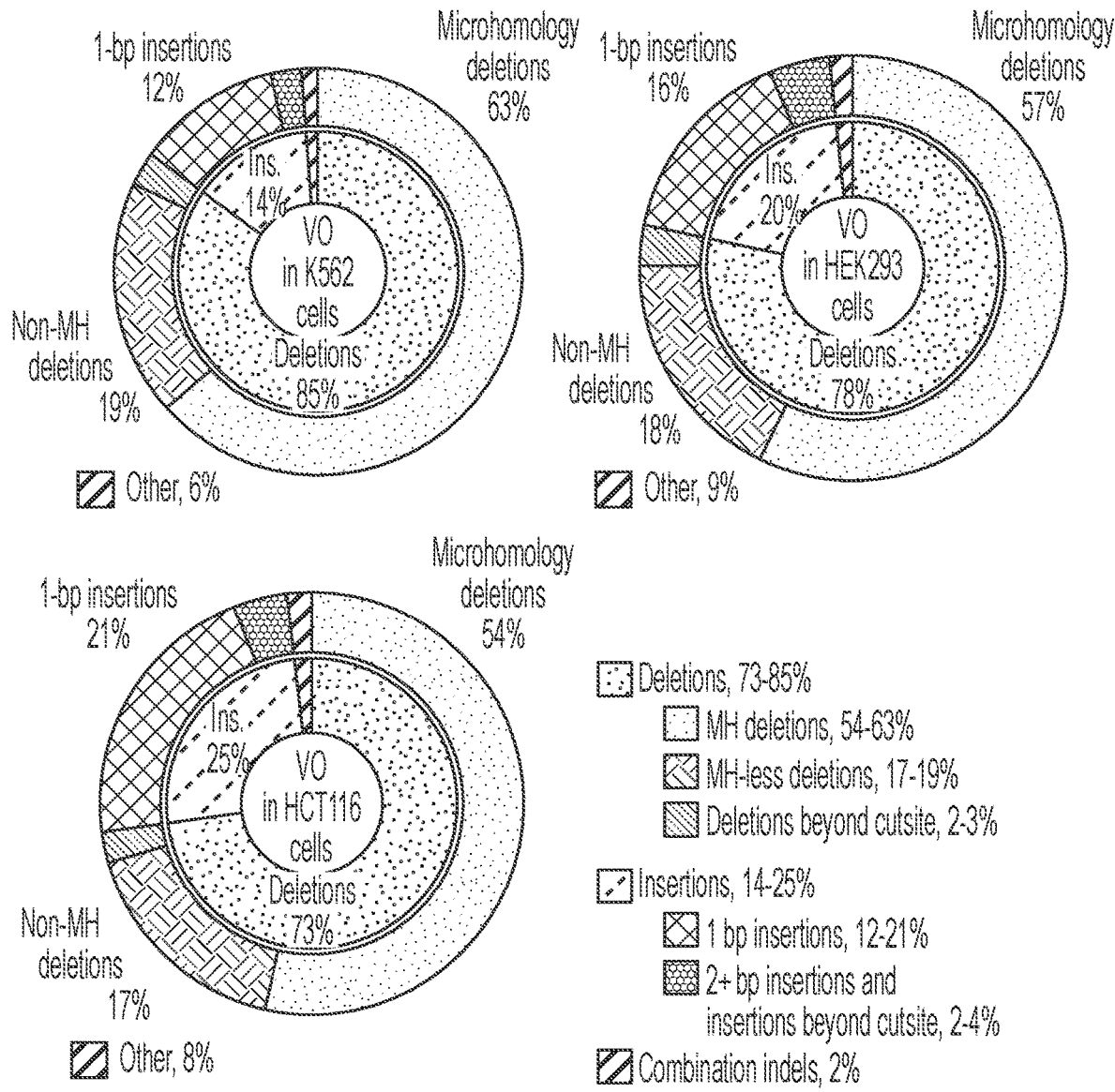
Figure 18A:
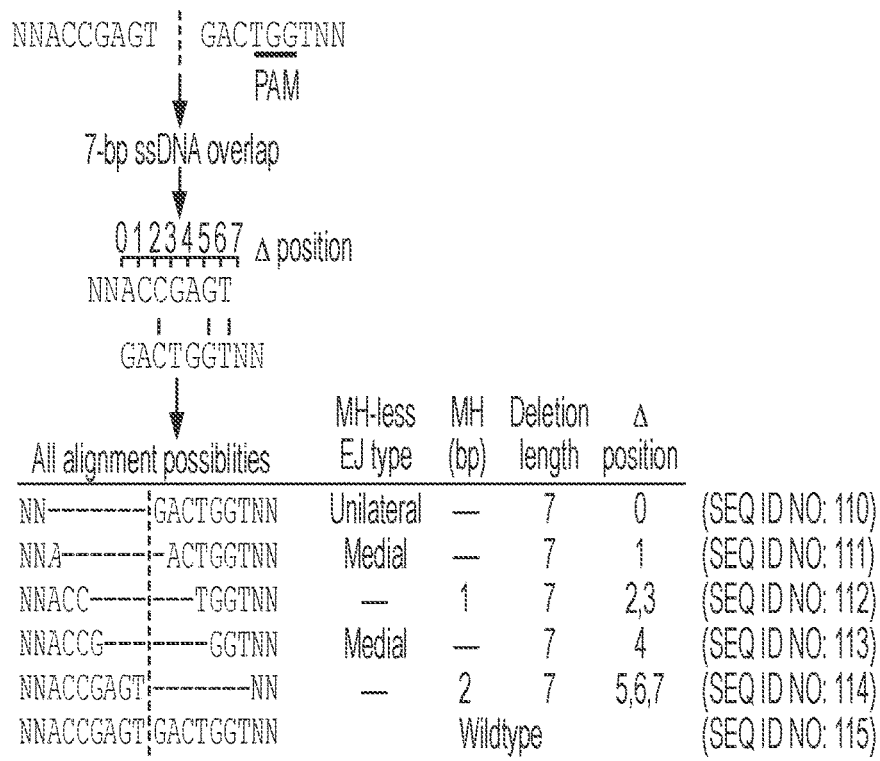
FIGS. 18A-18I show that sequence features correlated with higher and lower inDelphi phi scores.
Figure 18B:
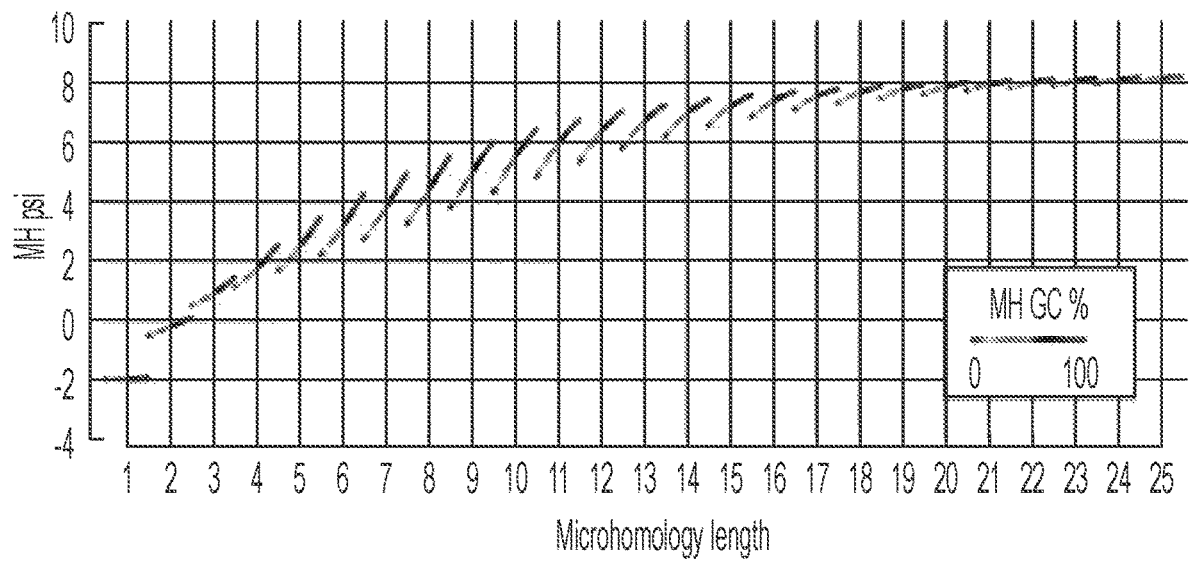
Figure 18C:
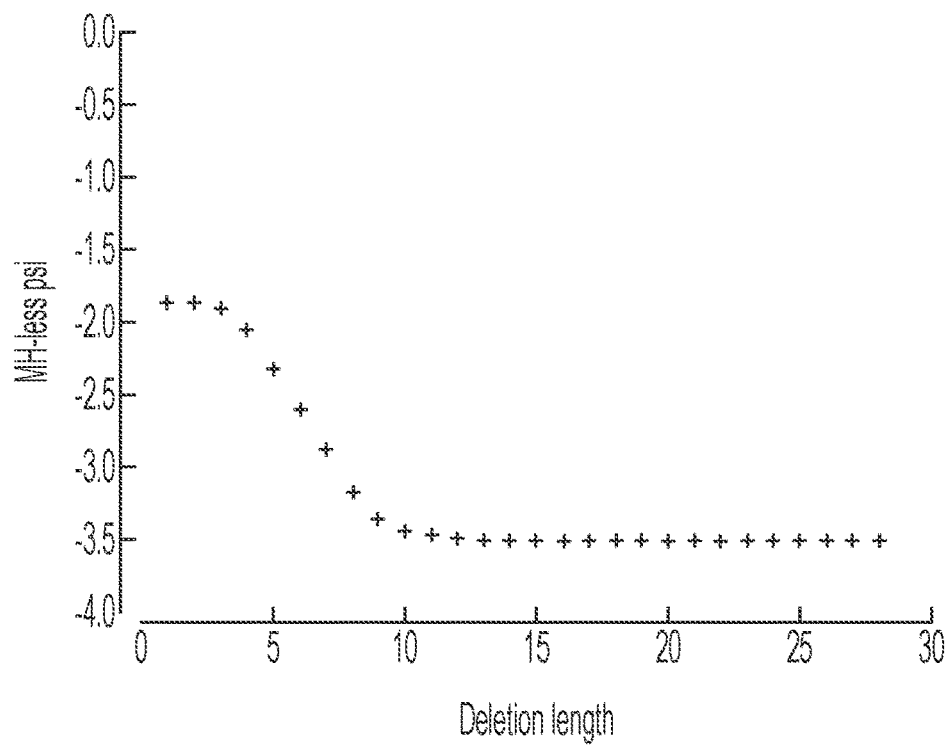
Figure 18D:
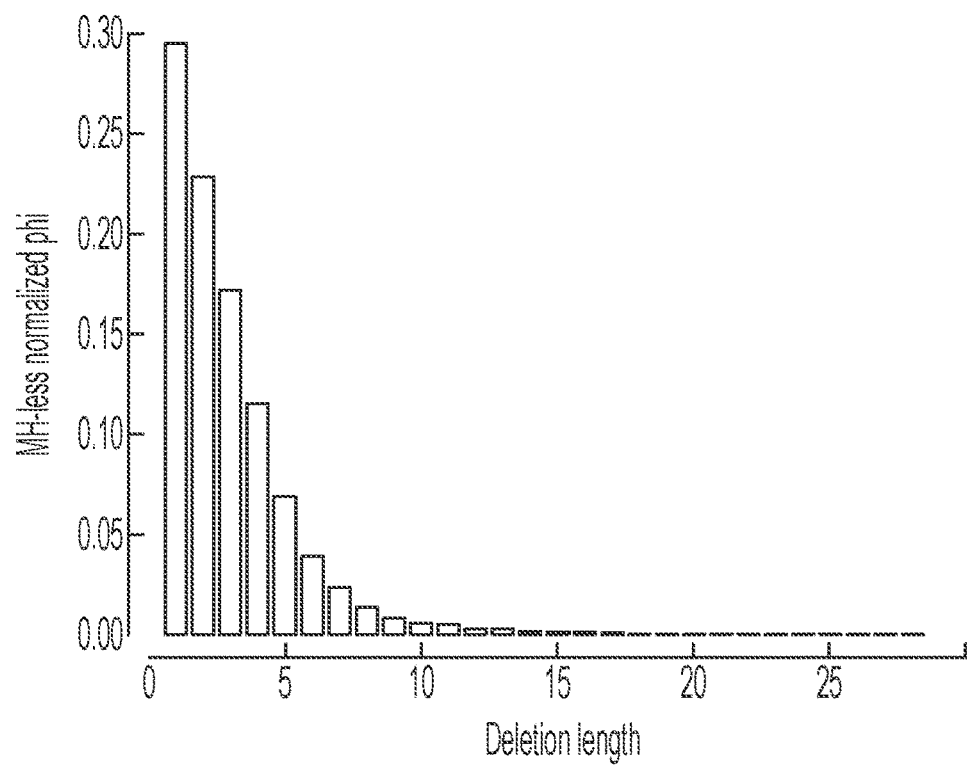
Figure 18E:
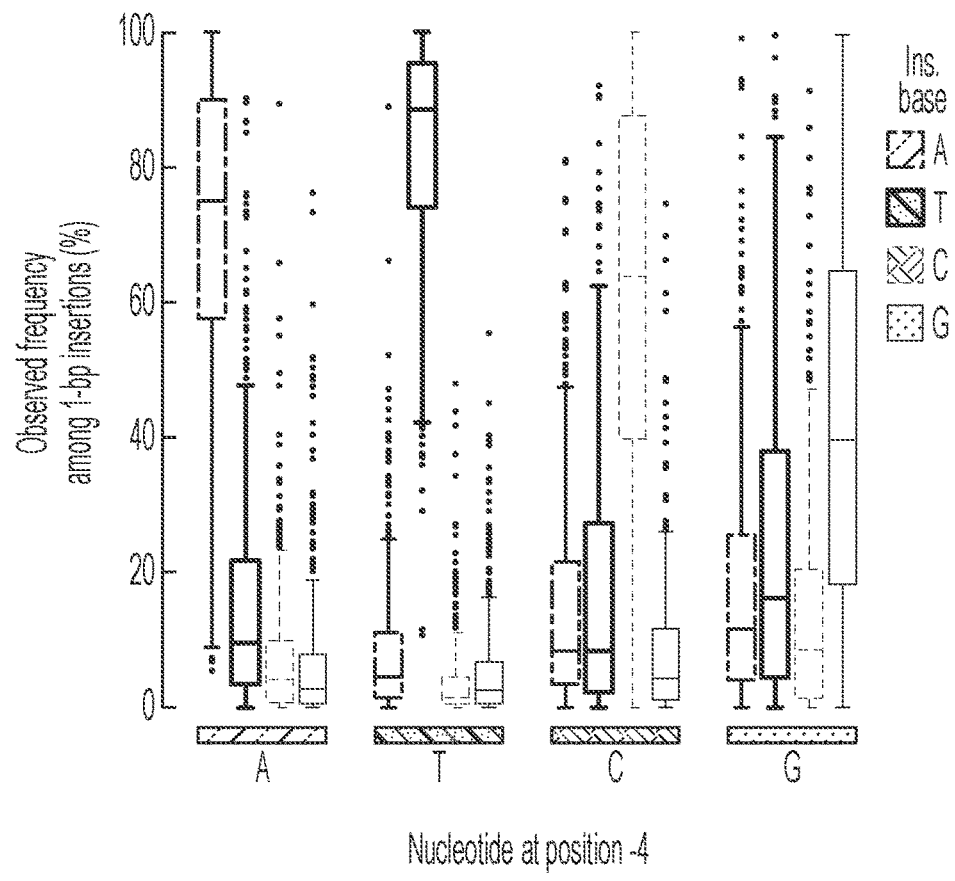
Figure 18F:
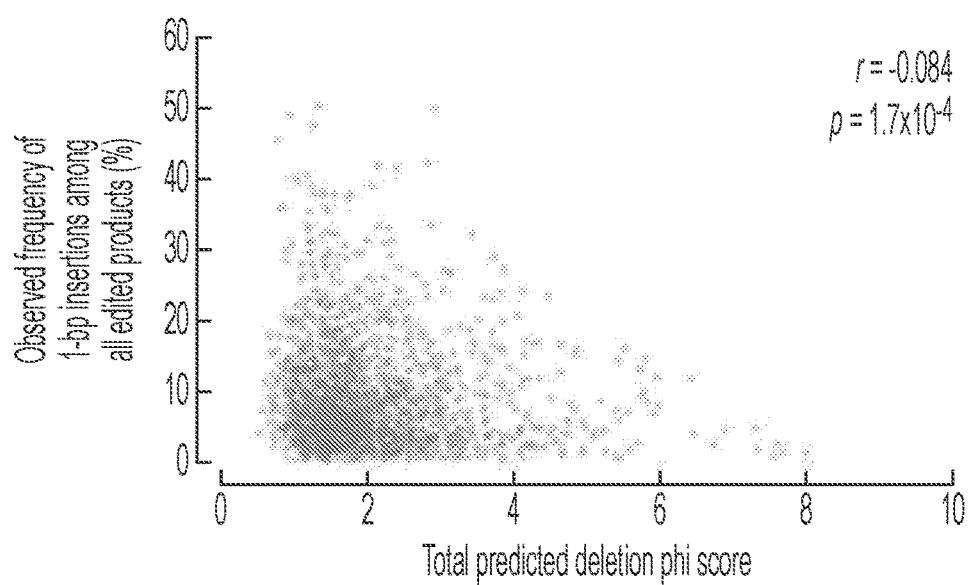
Figure 18G:
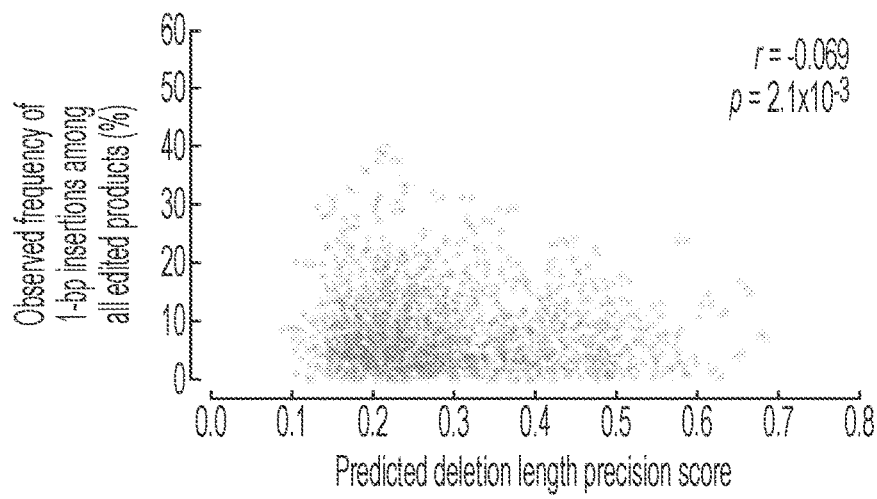
Figure 18H:
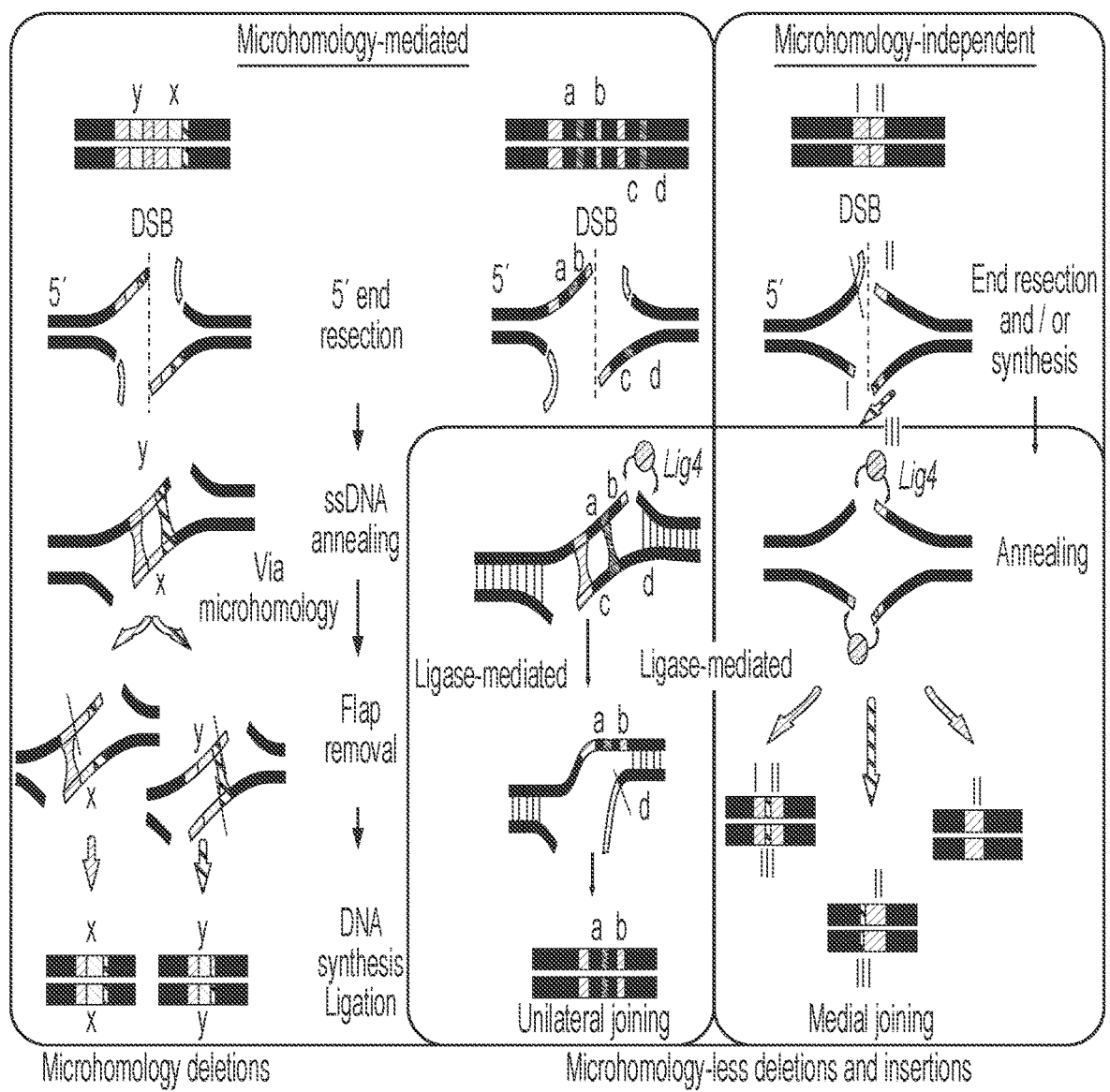
Figure 18I:
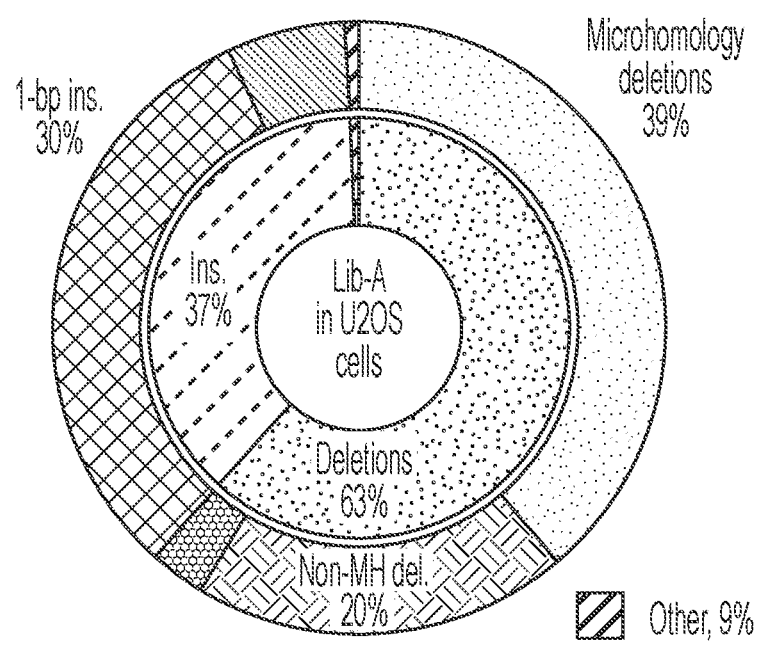
Figure 19A:
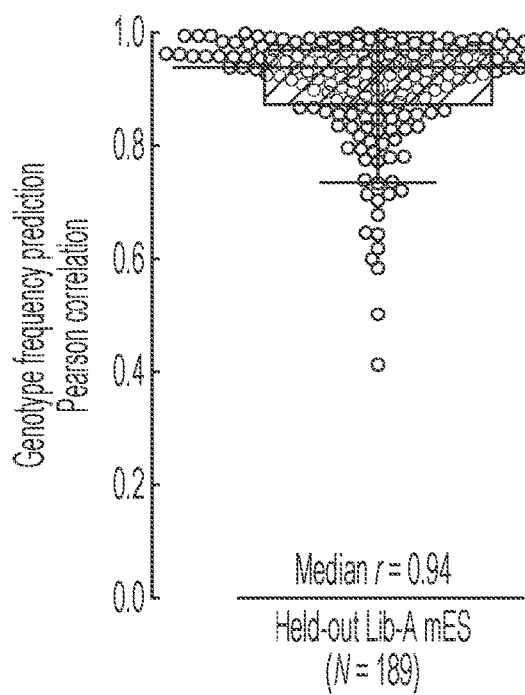
FIGS. 19A-19F show performance of inDelphi at predicting Cas9-mediated indel length and repair genotypes.
Figure 19B:
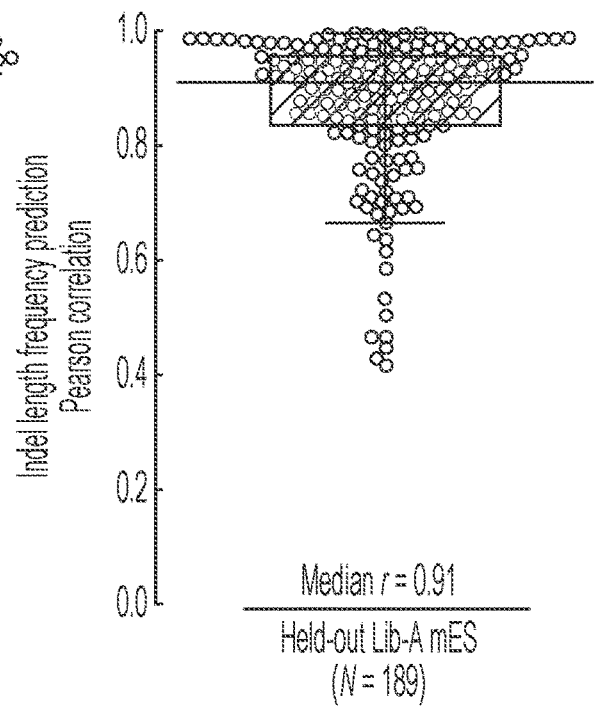
Figure 19C:
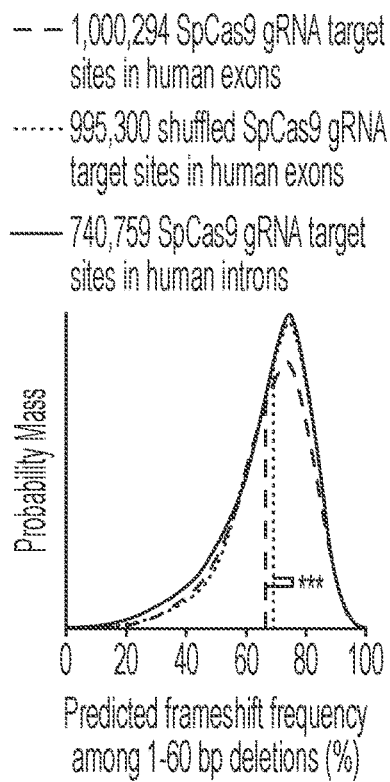
Figure 19D:
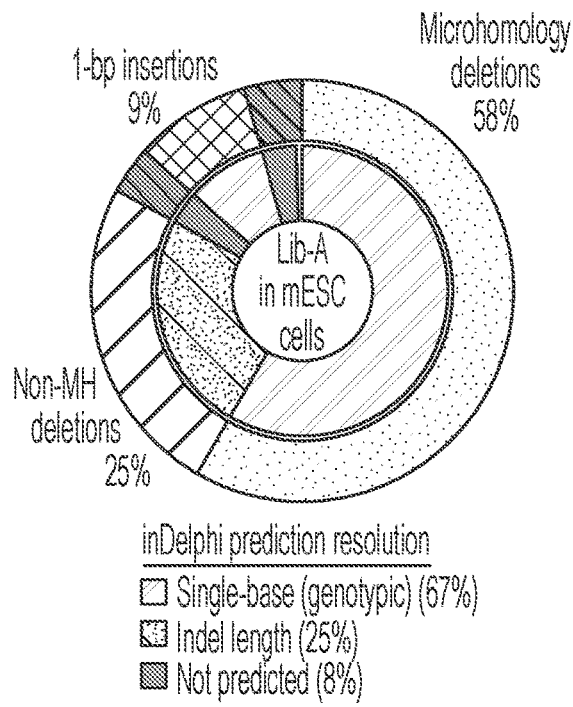
Figure 19E:
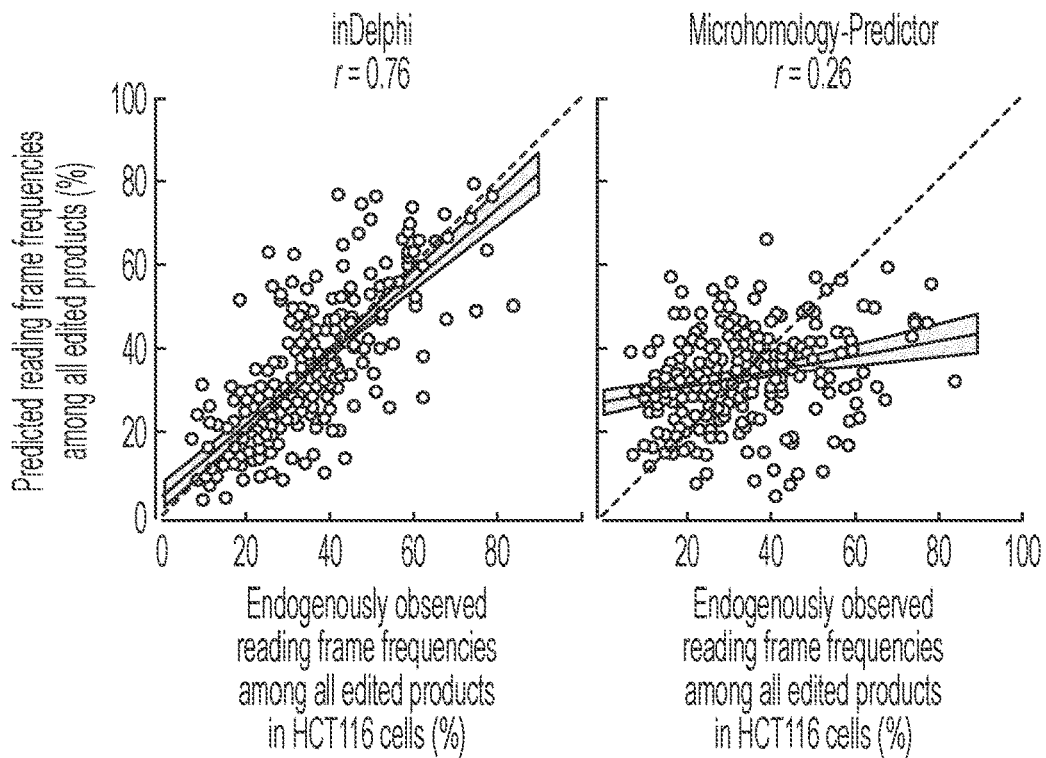
Figure 19F:
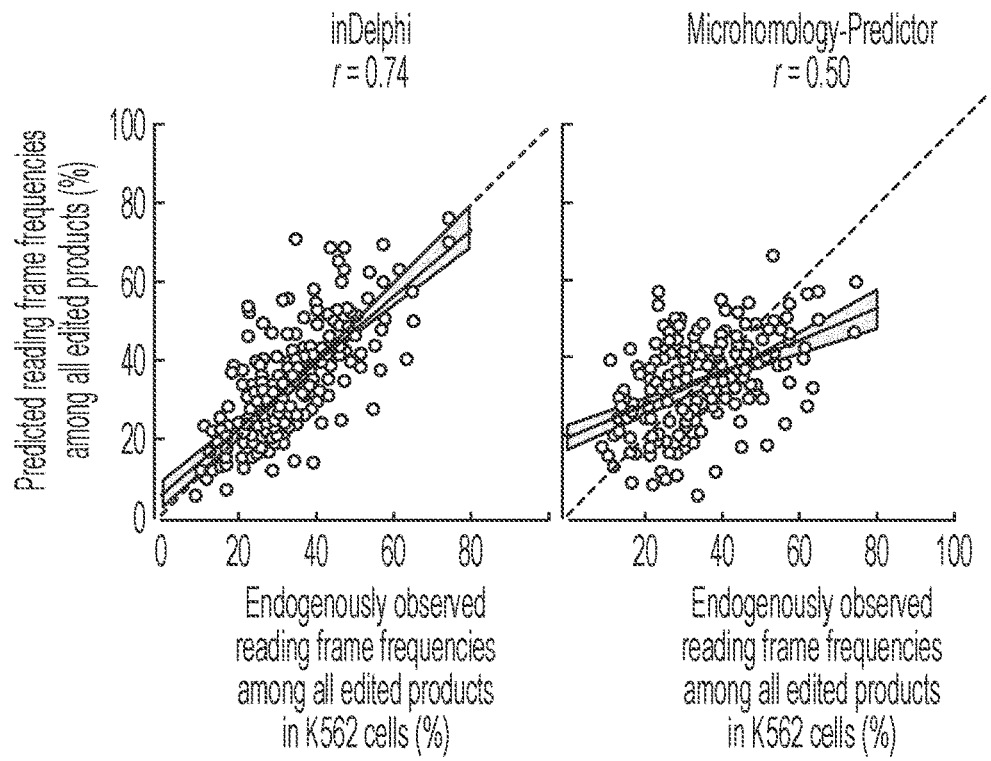
Figure 20A:
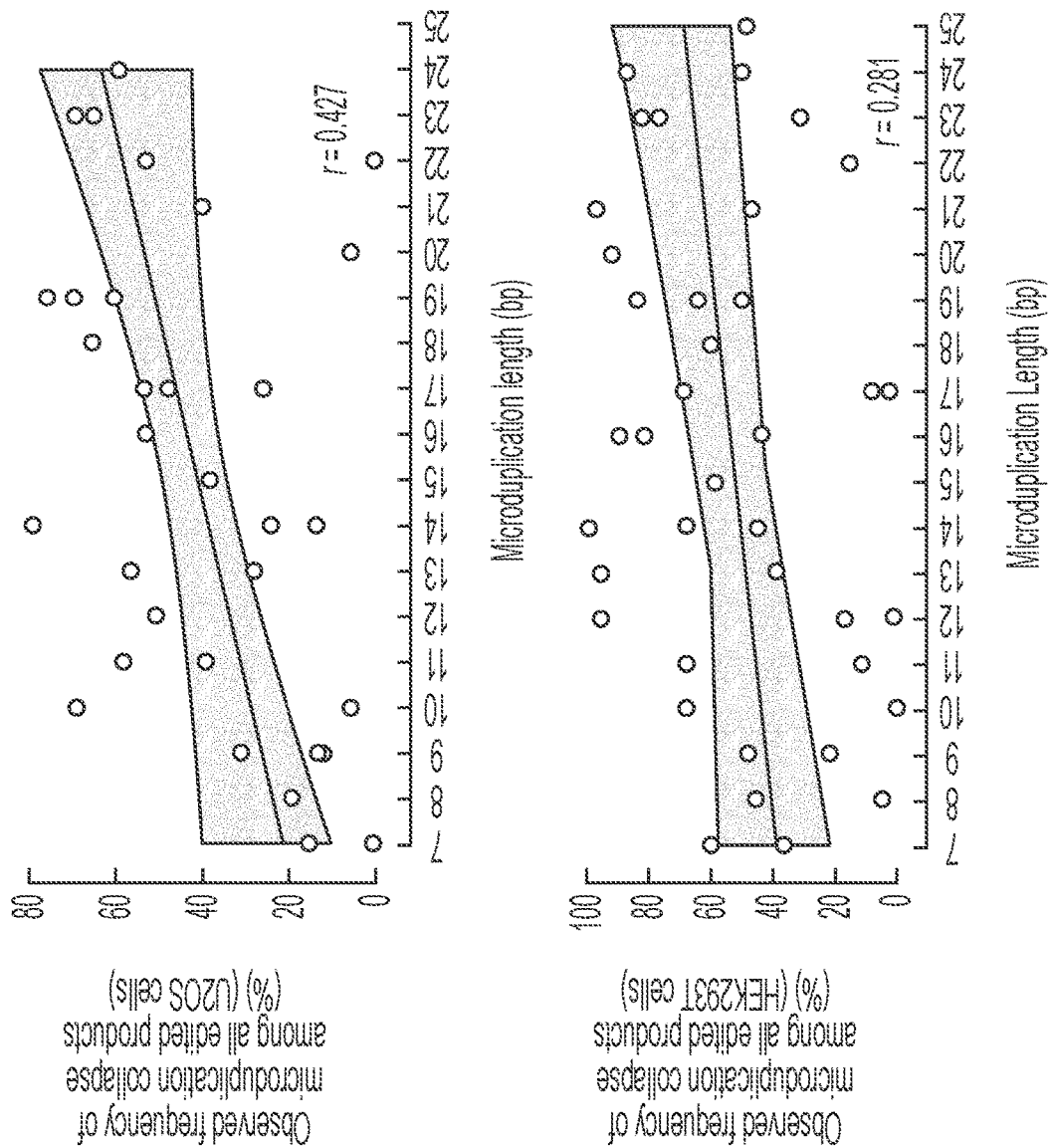
Figure 20B:
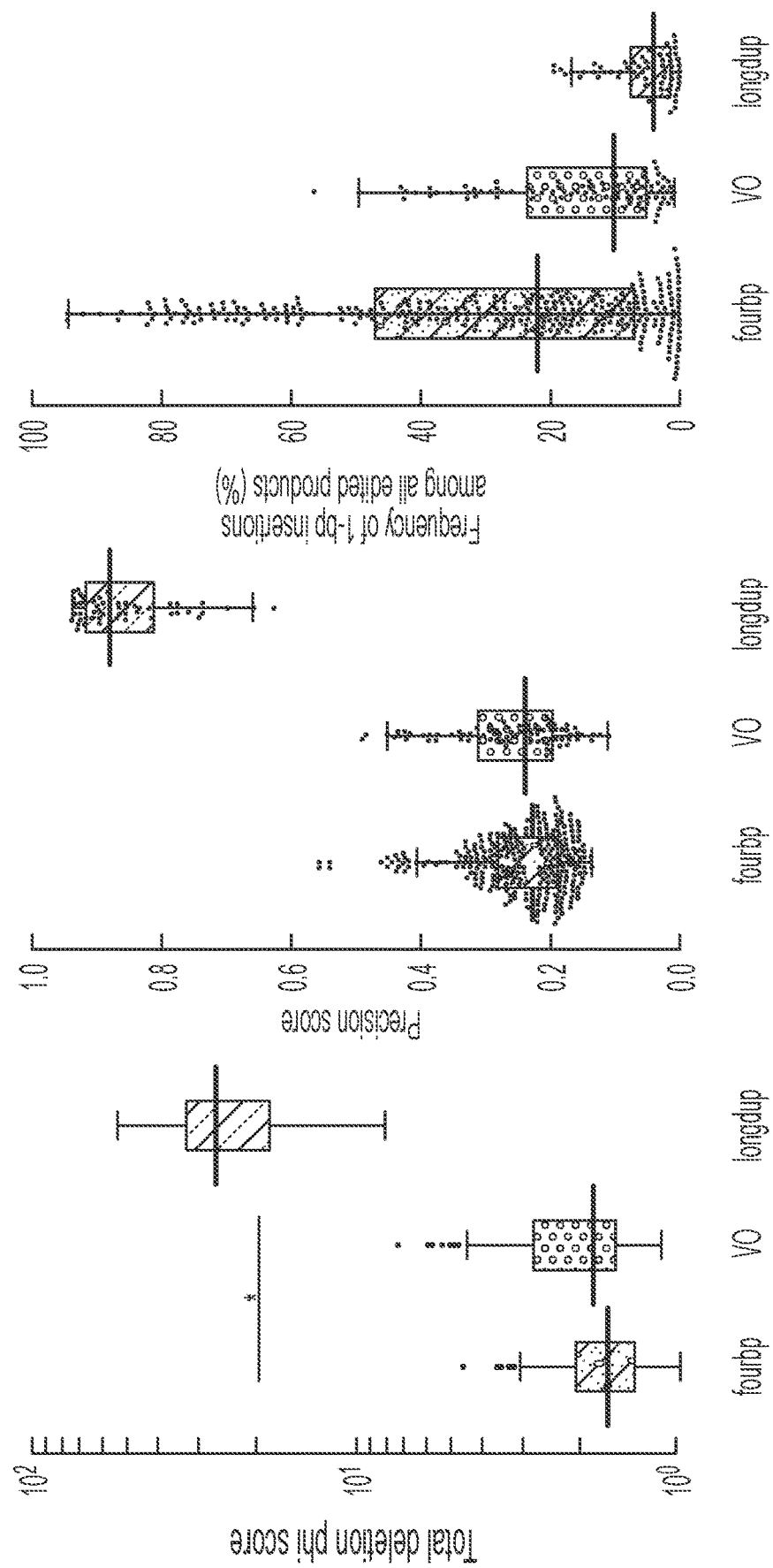
Figure 20C:
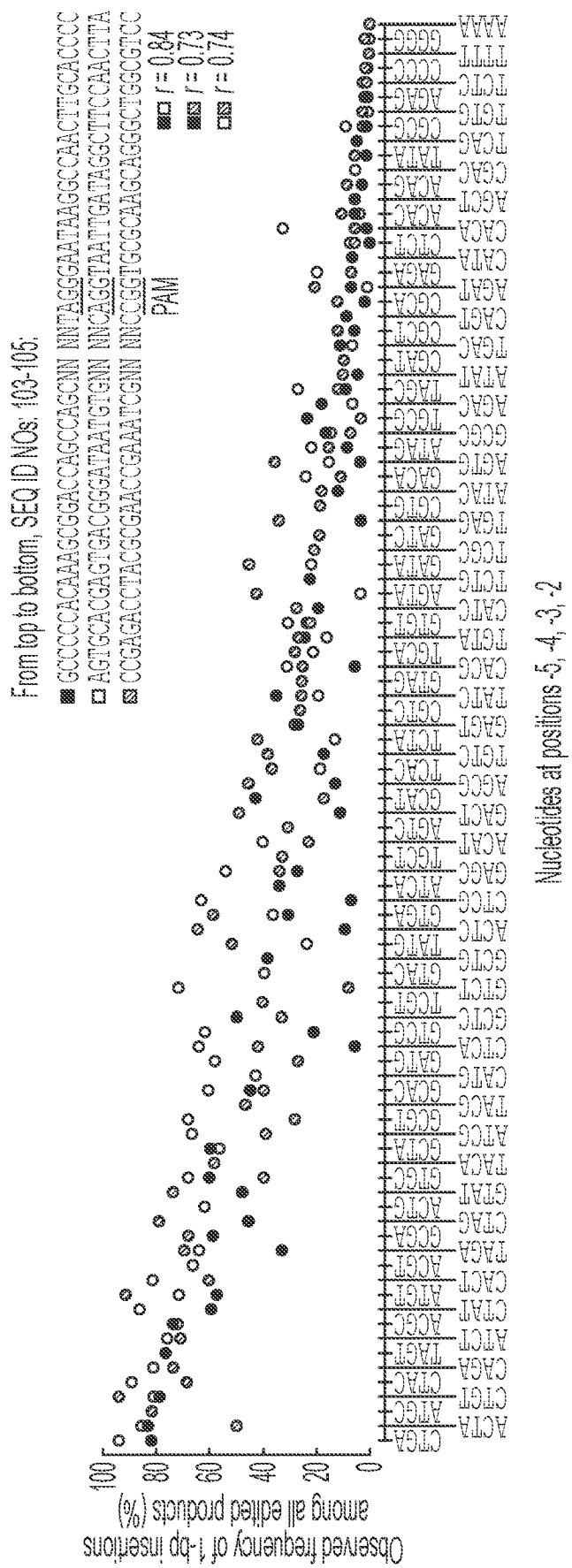
Figure 20E:
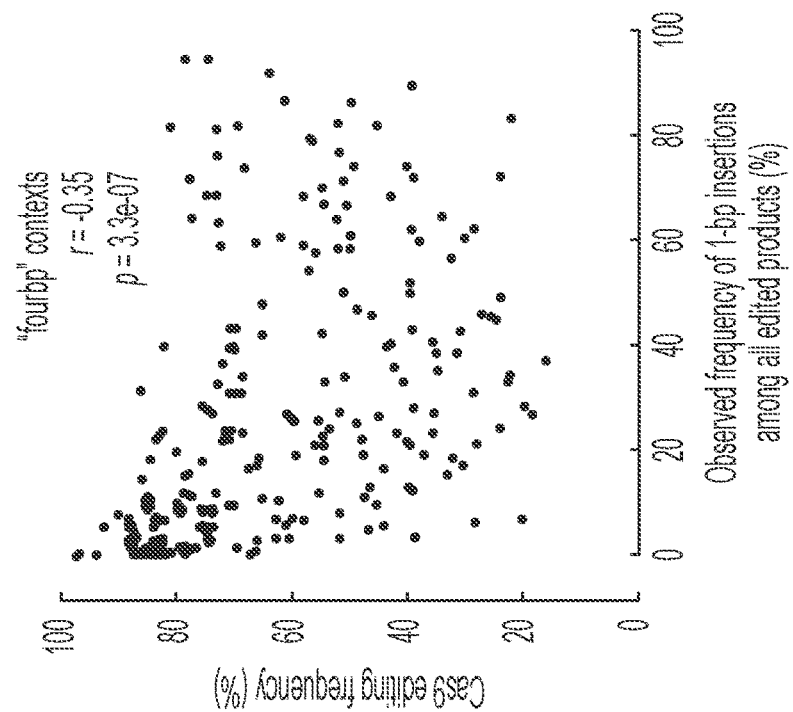
Figure 20D:
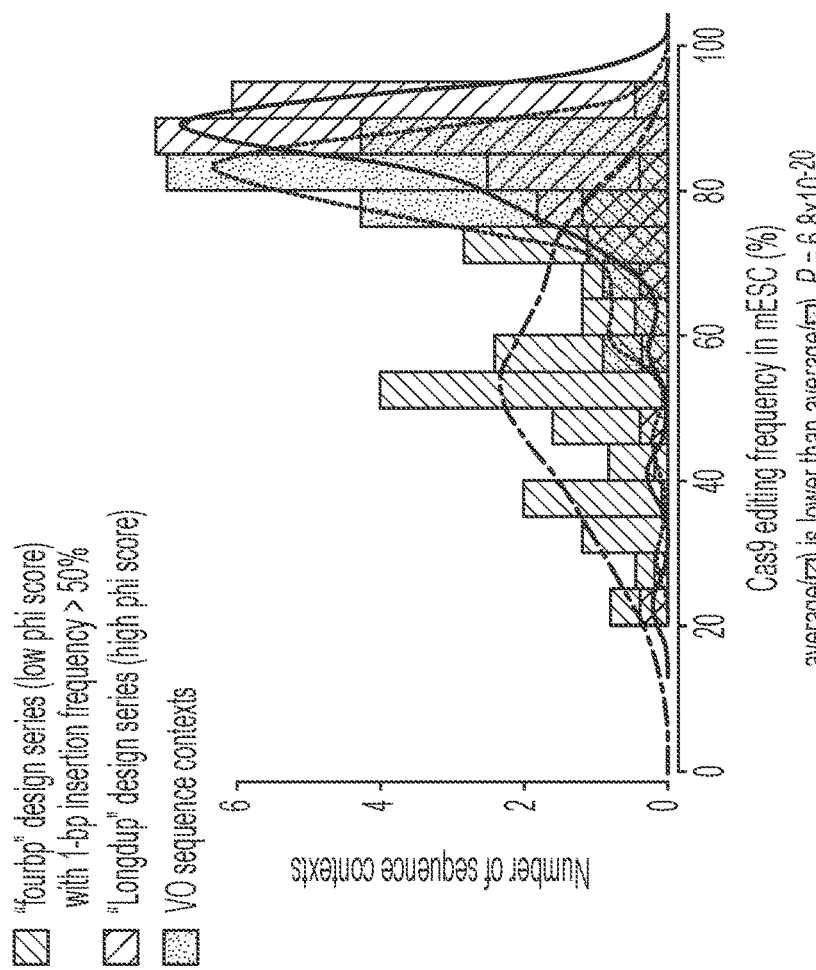
Figures 20G, 20H:
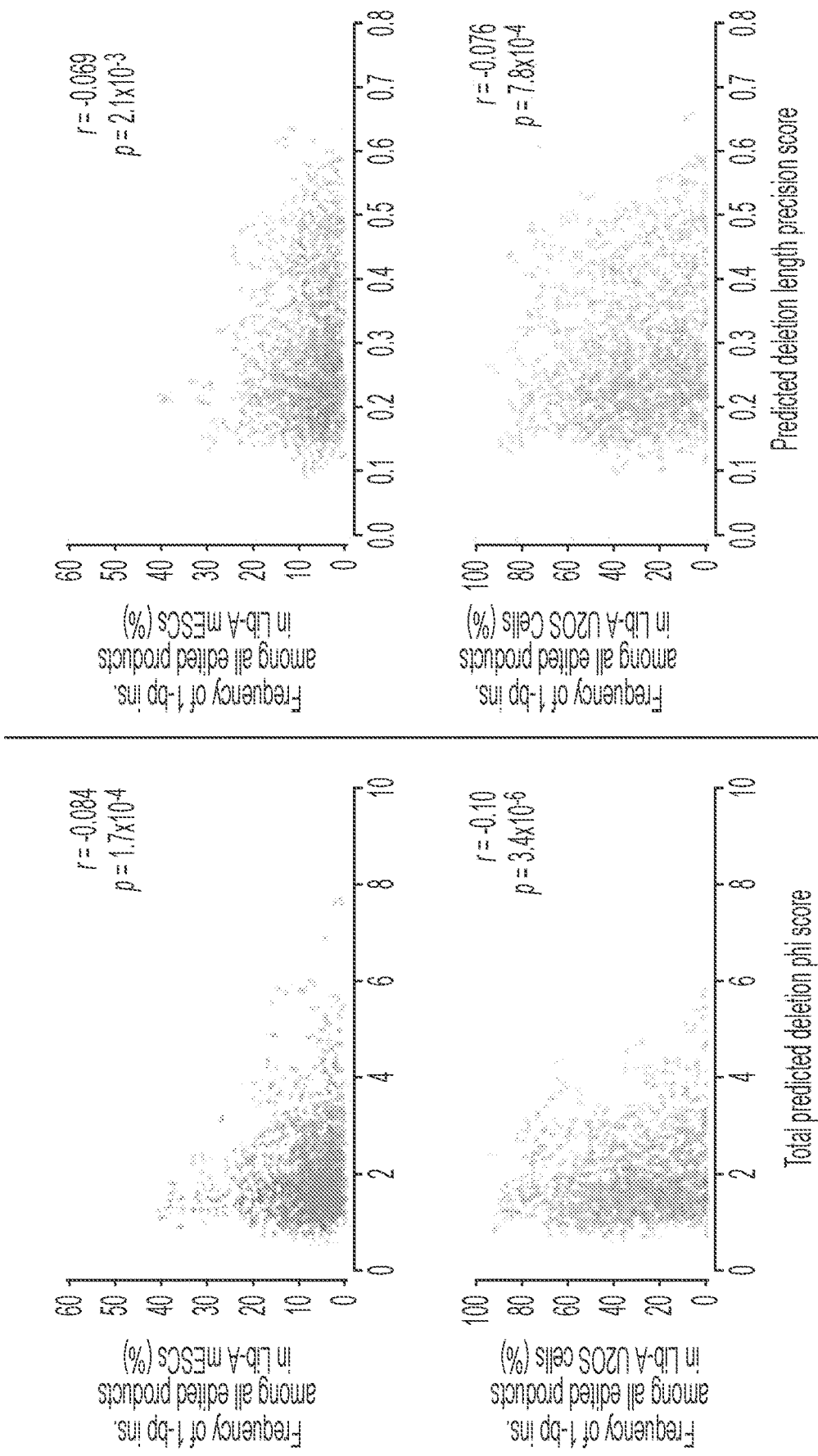
Figure 20J:
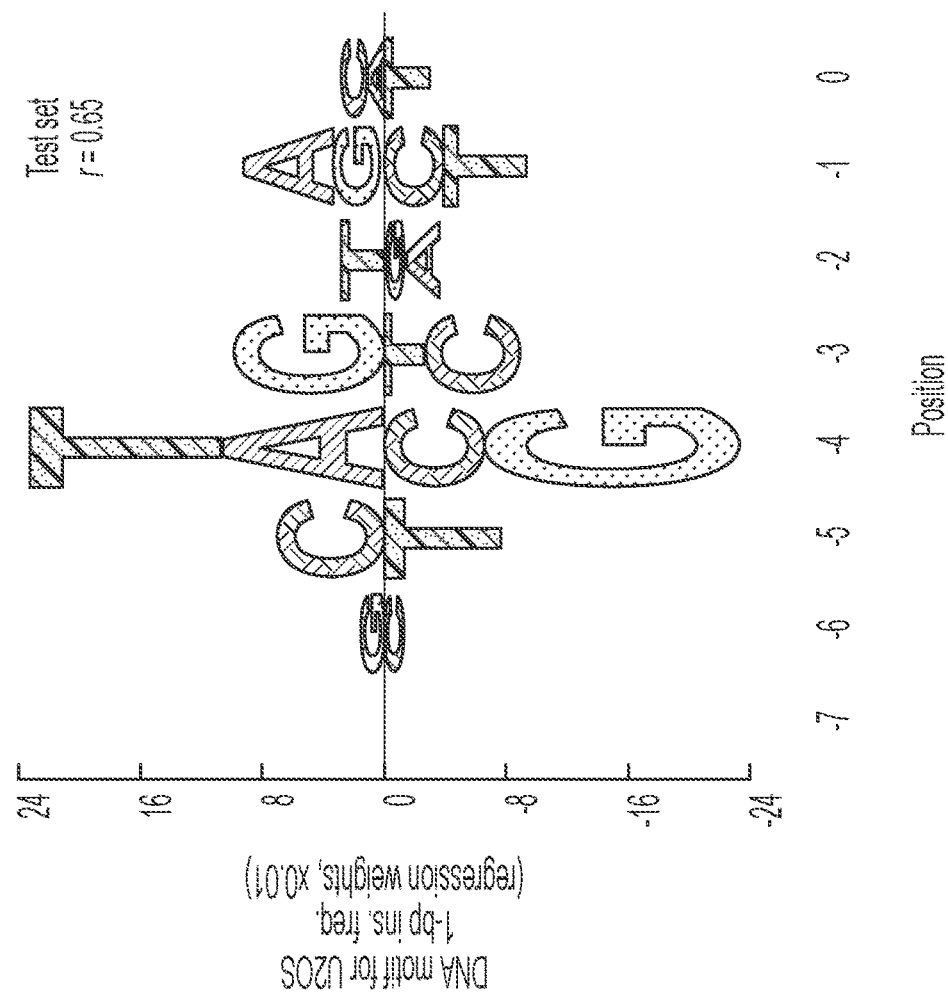
Figure 20I:
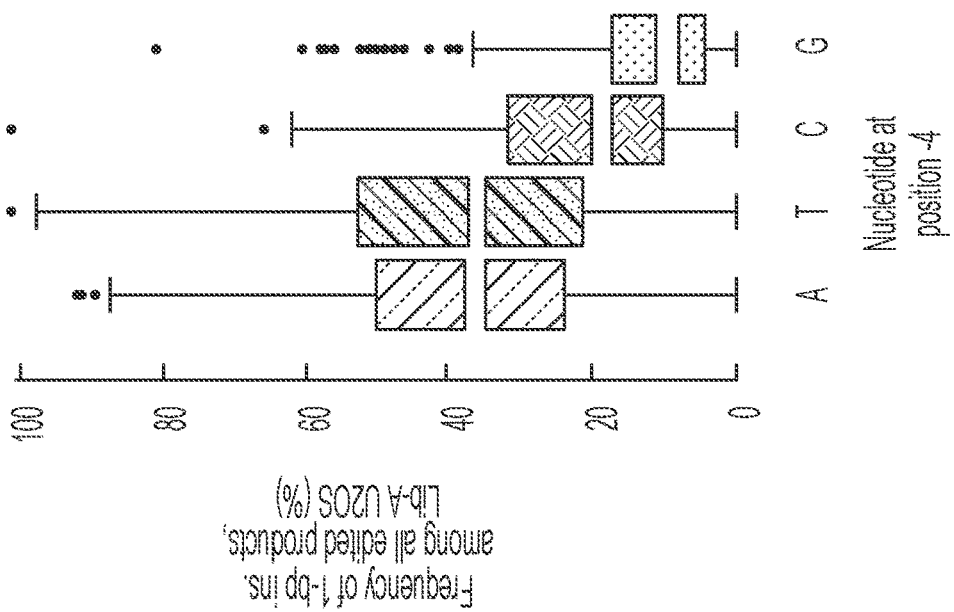
Figure 20K:
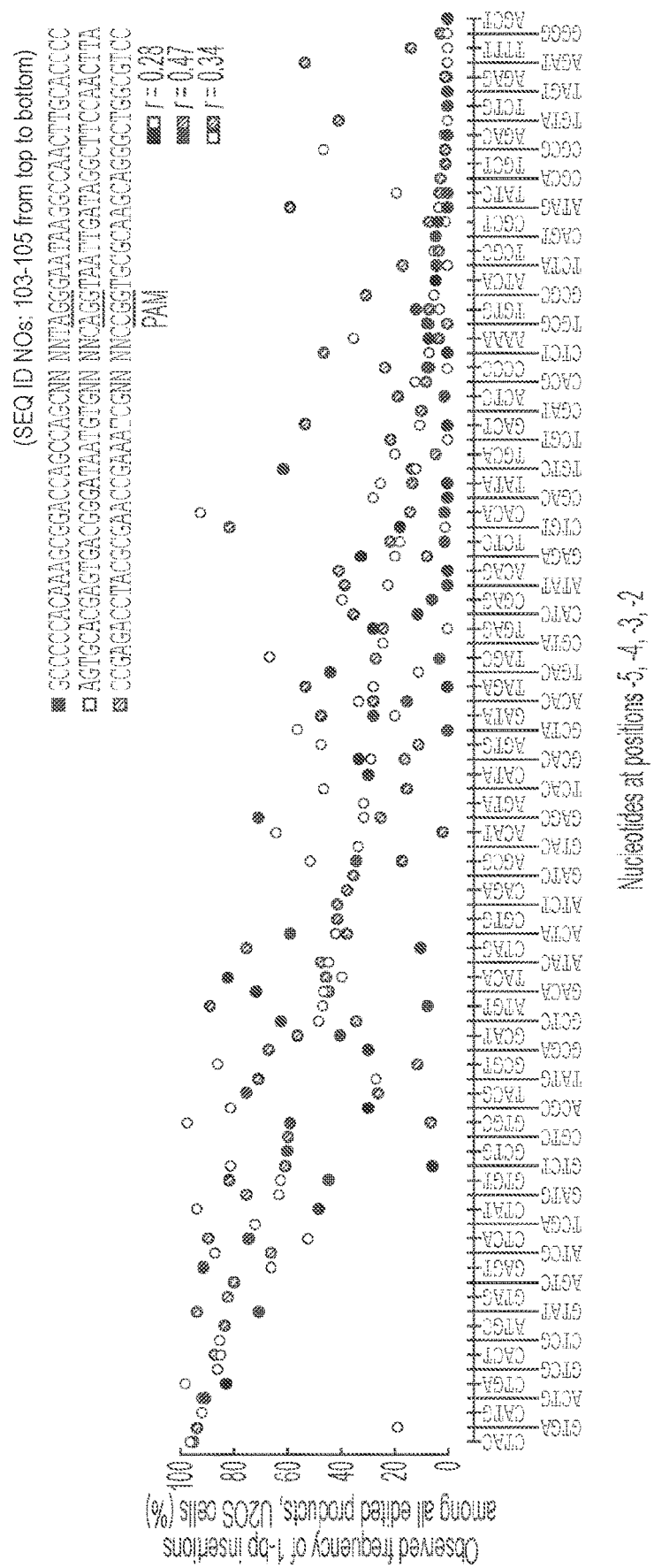
Figures 21A, 21B:
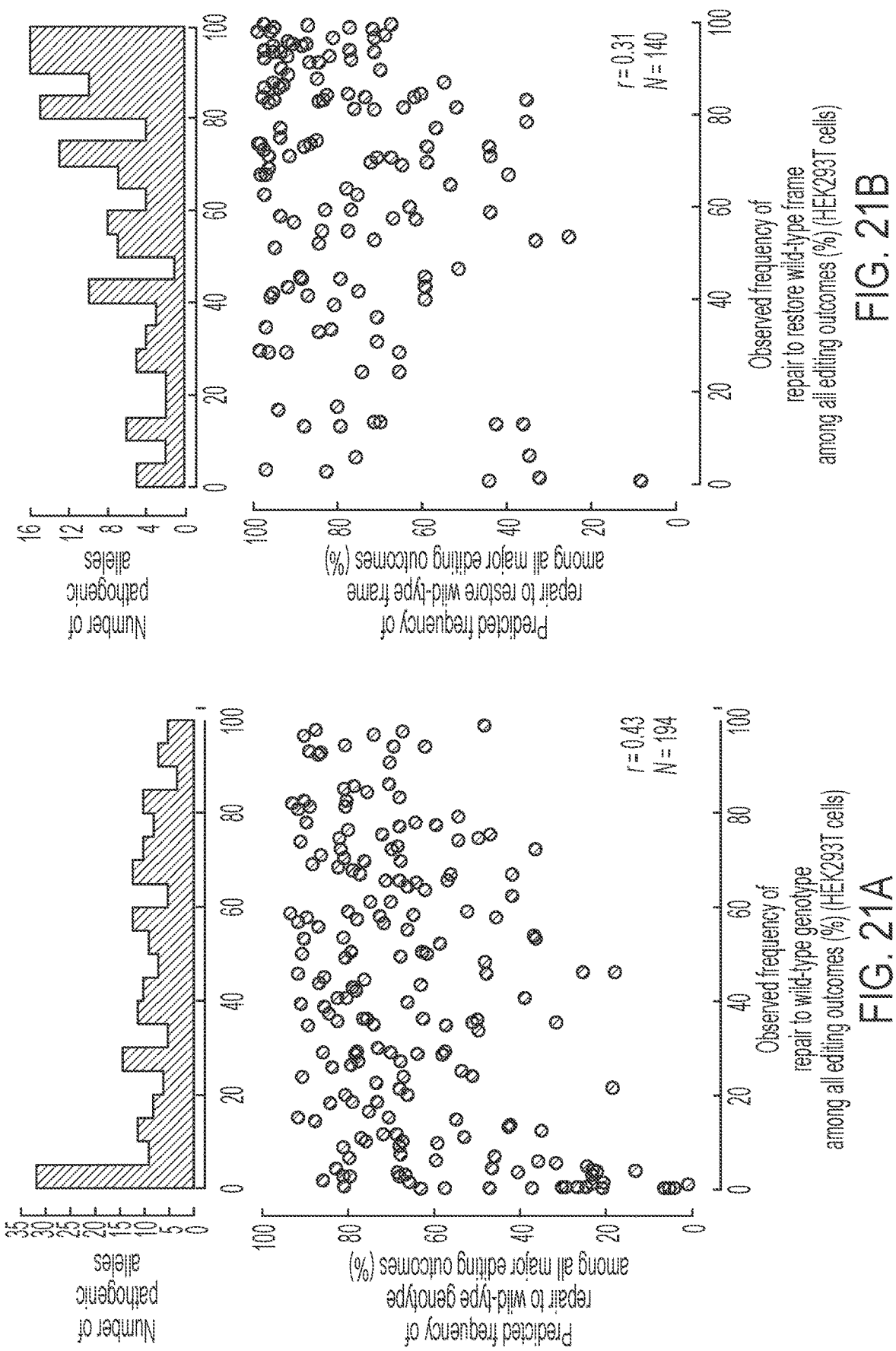
FIGS. 21A-21D show the precise repair of pathogenic microduplications.
Figures 21C, 21D:
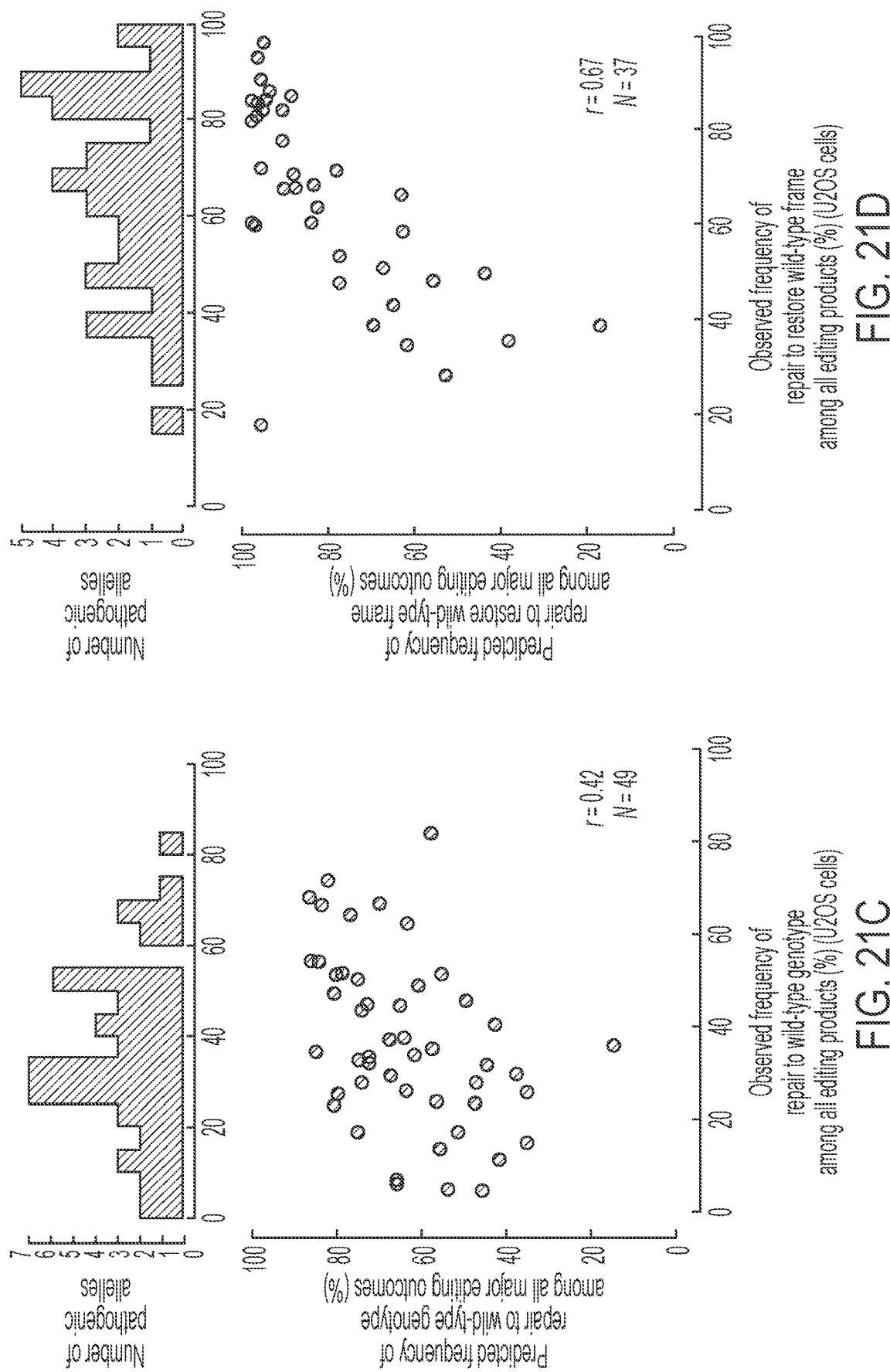
Figure 22A:
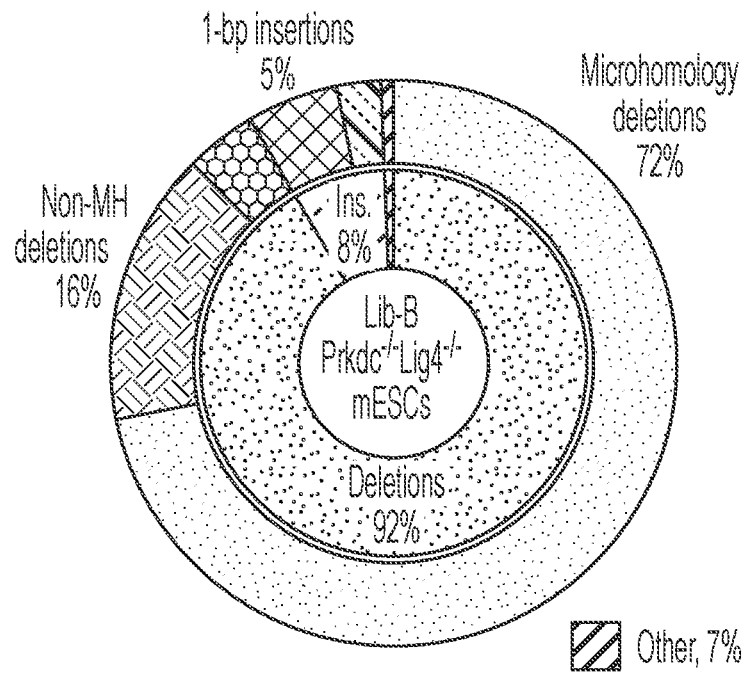
FIGS. 22A-22E show altered distribution of Cas9-mediated genotypic products in Prkdc−/−Lig4−/− mESCs as compared to wild-type mESCs.
Figure 22B:
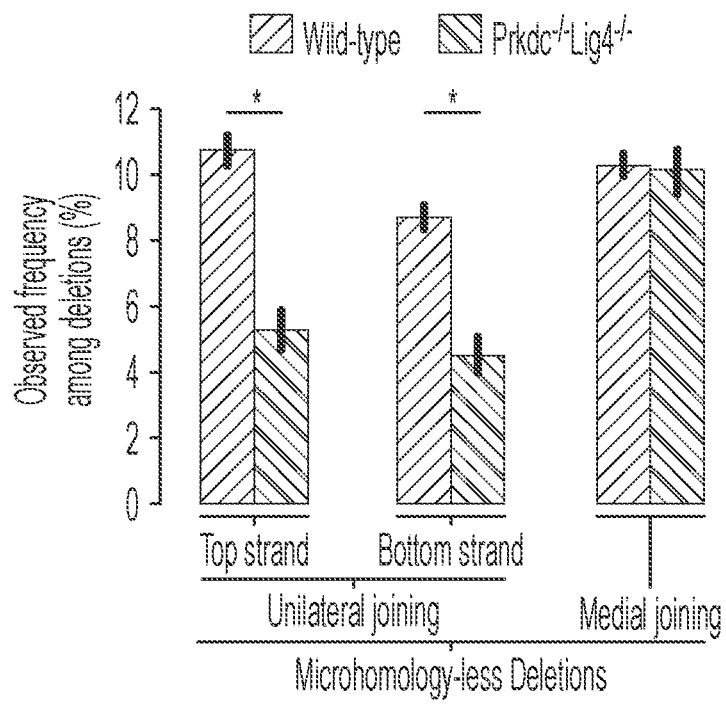
Figure 22C:
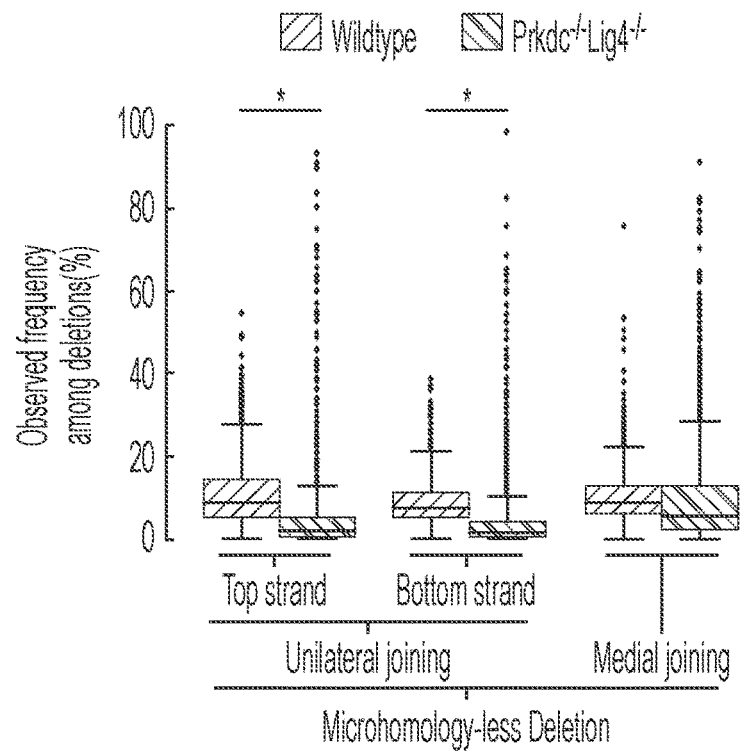
Figure 22D:
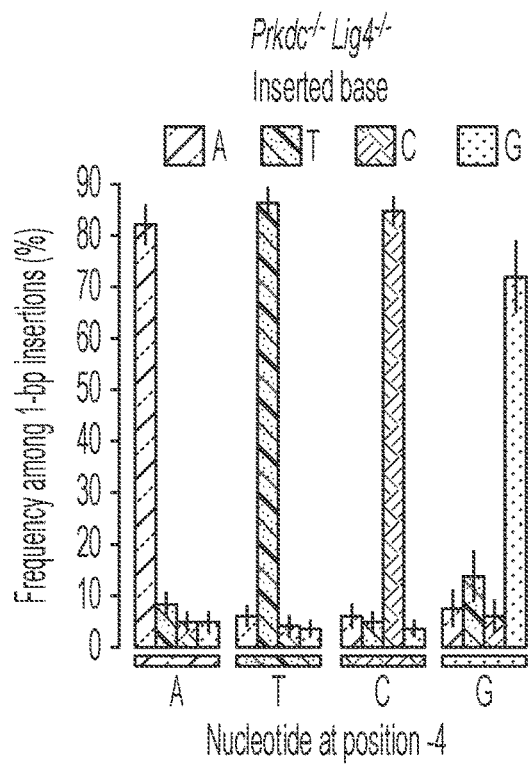
Figure 22E:
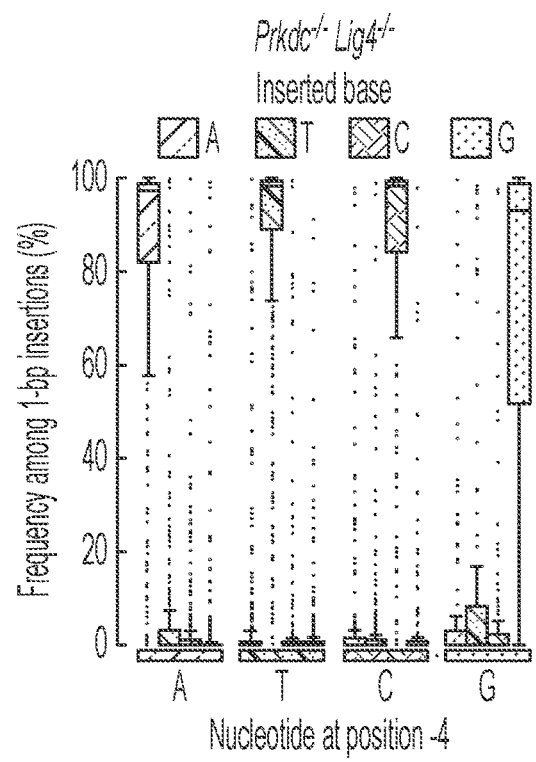
Figure 23A:
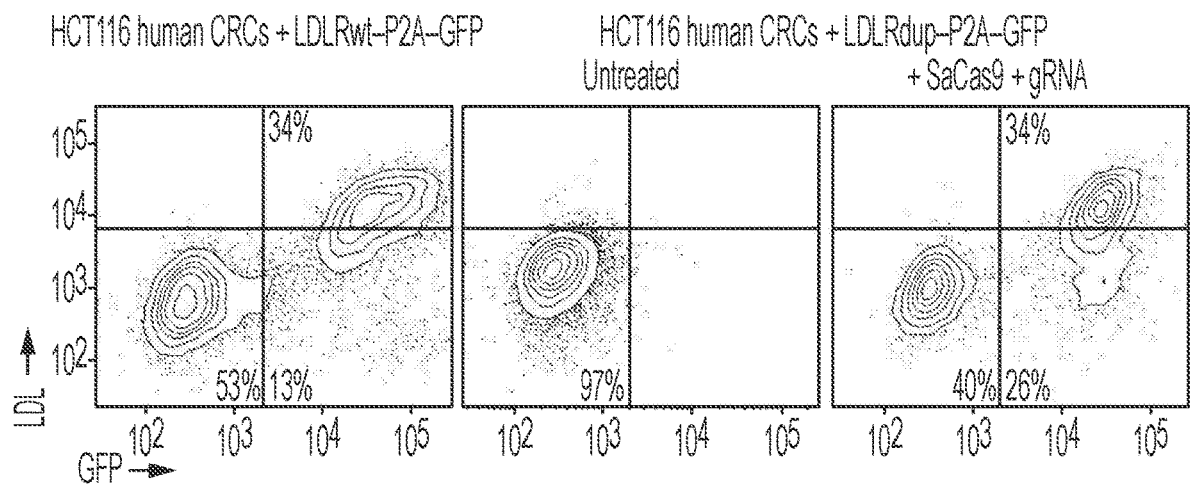
Figure 23B:
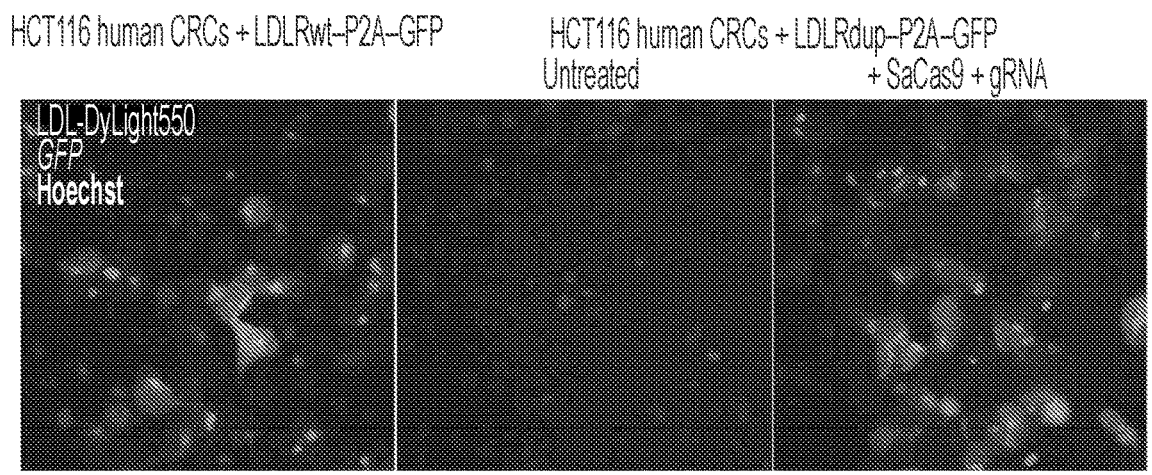
Figure 23C:
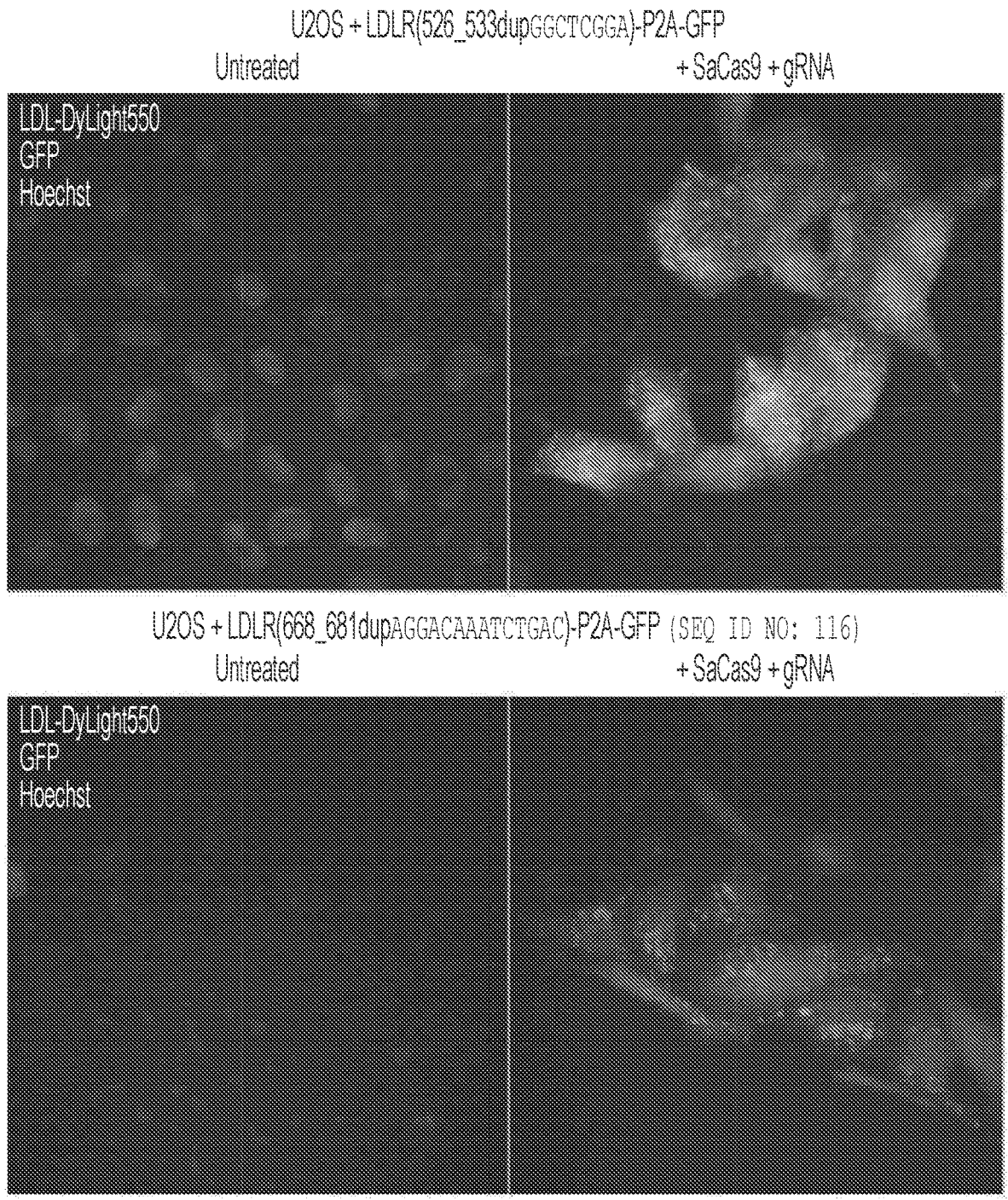
Figure 23D:
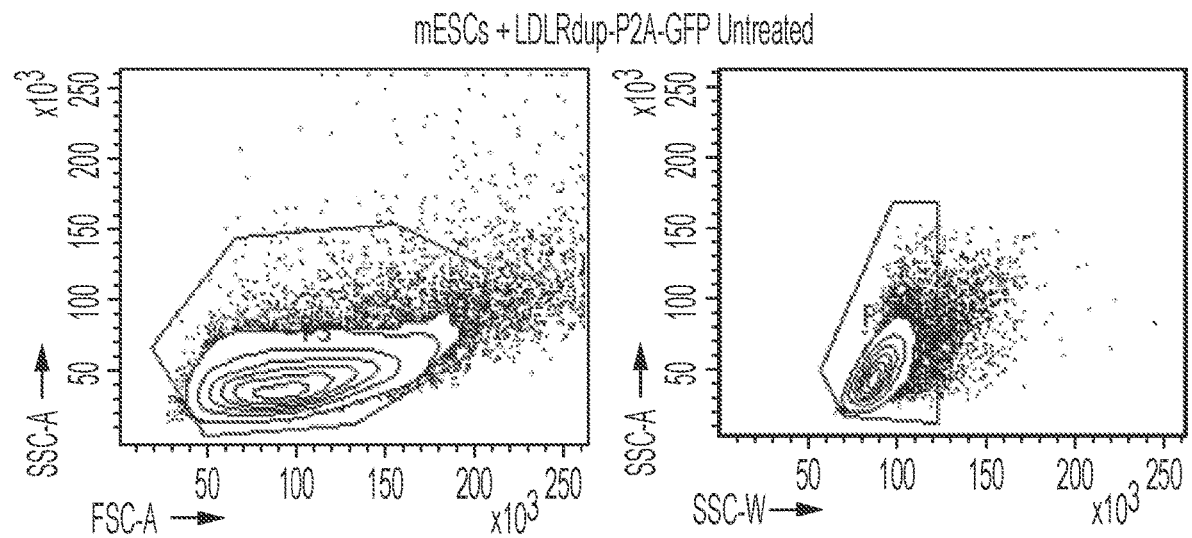
Figure 23E:
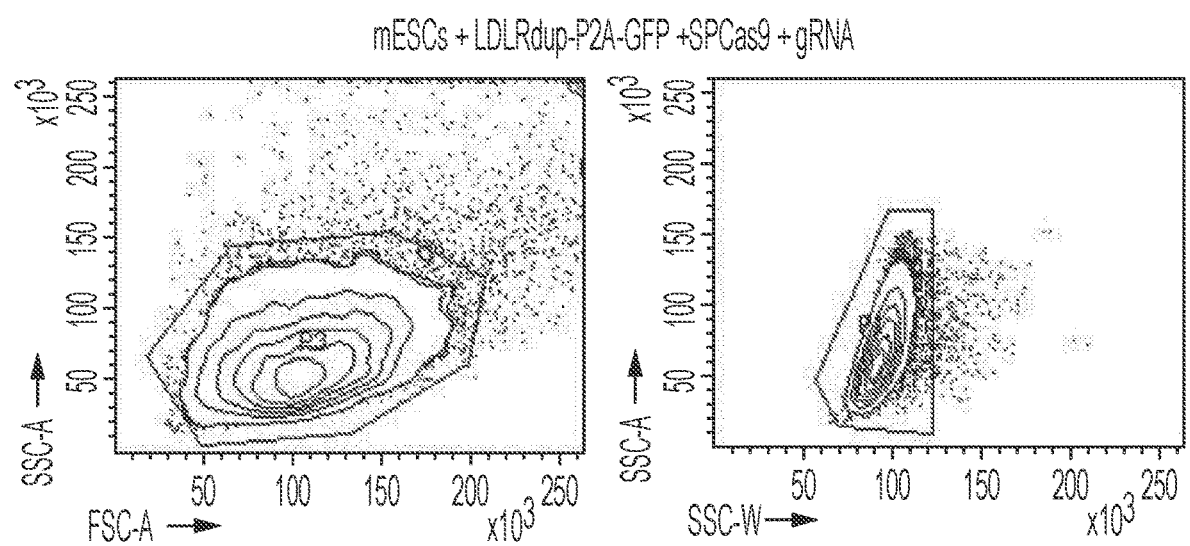
Figure 23F:
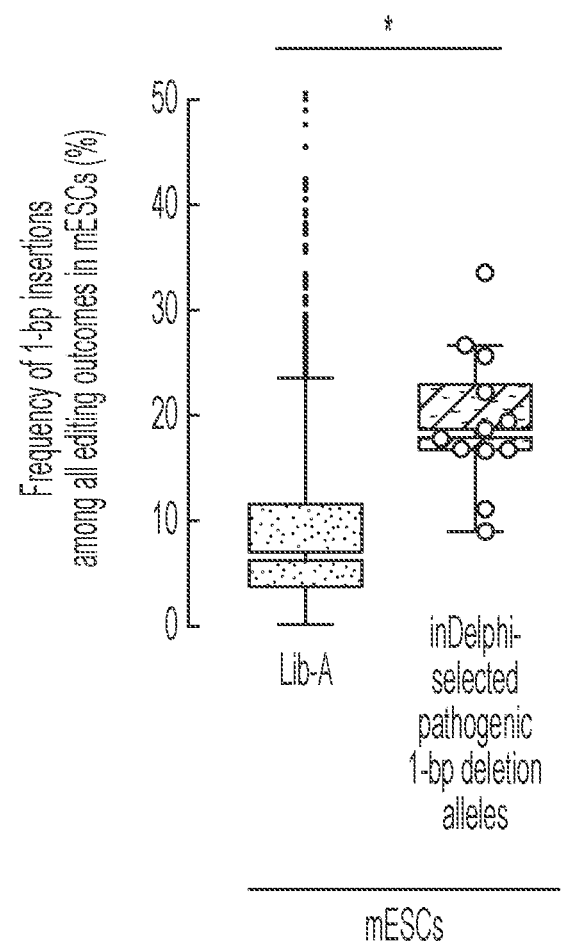
Figure 23H:
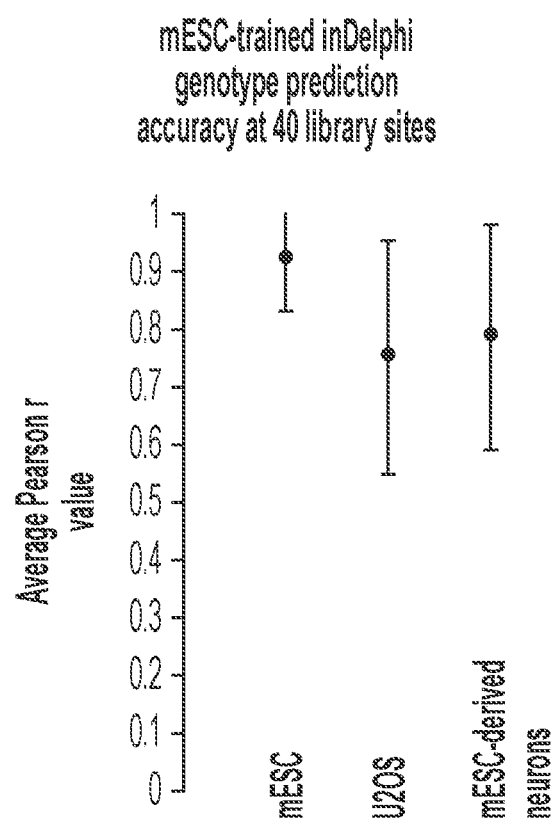
Figure 24A:
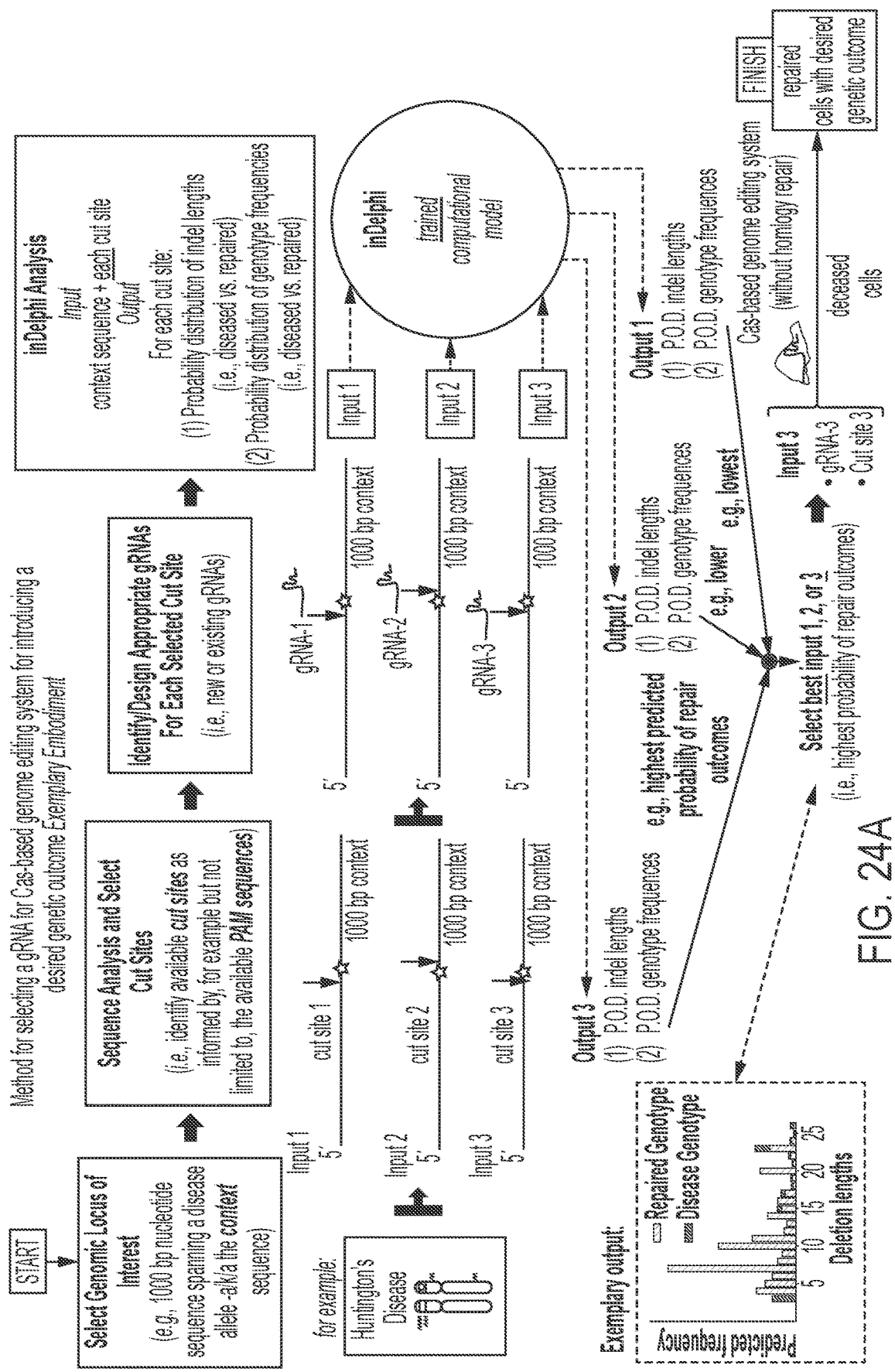
FIG. 24A is a schematic depicting an exemplary method of using a trained computational model (e.g., "inDelphi") in conjunction with a Cas-based genome editing system to edit a nucleotide sequence (e.g., a genome) to achieve a desired genetic outcome (e.g., a correction to a disease-causing mutation to treat a disease, or modification of a wildtype type gene to confer an improved trait or phenotype). For any given set of inputs (a context sequence and a selected cut site), the trained computational model computes the probability distribution of indel lengths and the probability distribution of genotype frequencies, enabling the user to select the optimal input (e.g., cut site) for conducting editing by a Cas-based genome editing system to achieve the highest frequency of desired genetic output. The computational method may be used to predict, for a given local sequence context, template-free repair genotypes and frequencies of occurrence thereof.
Figure 24B:
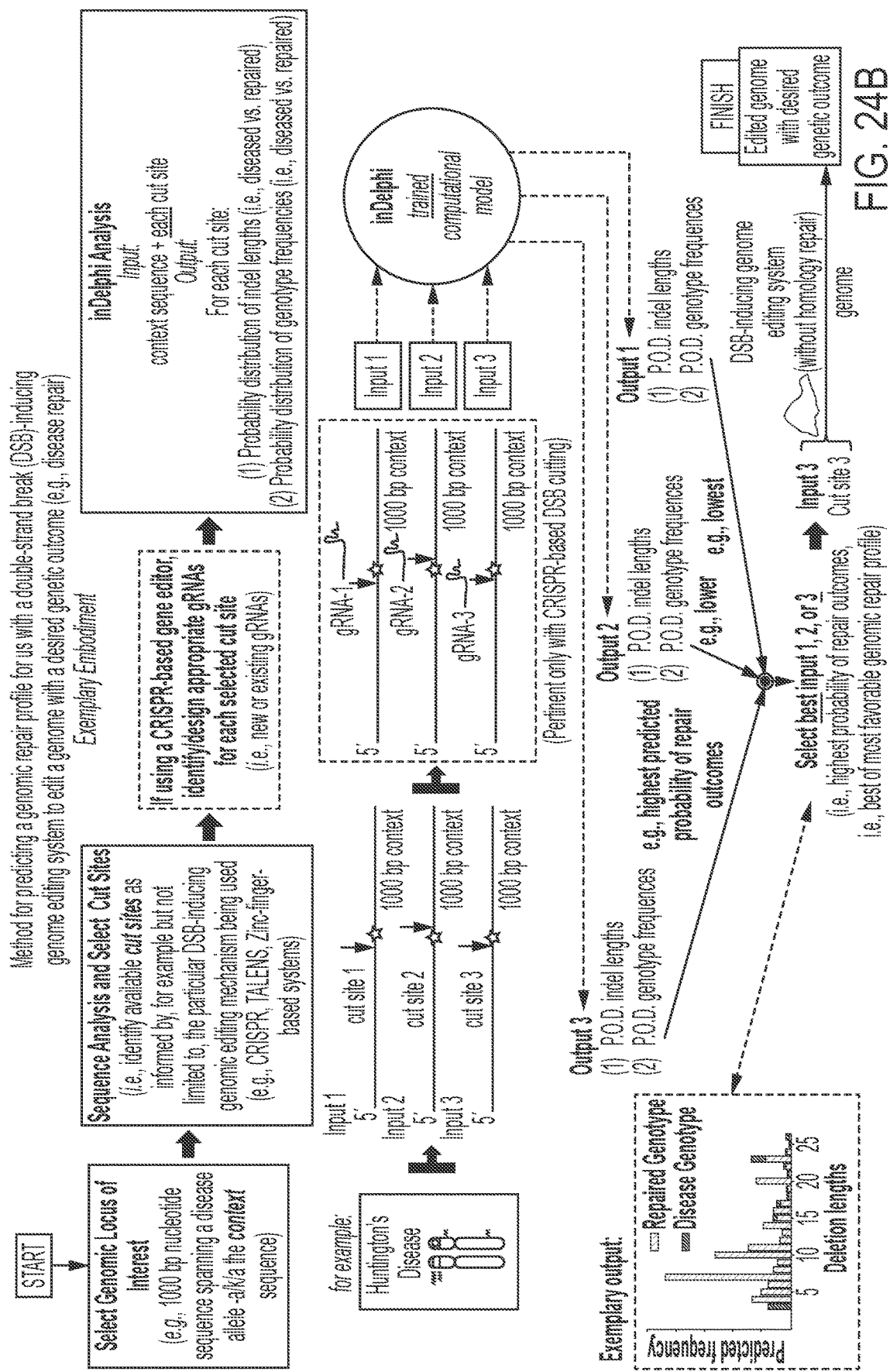
FIG. 24B is a schematic depicting an exemplary method of using a trained computational model (e.g., "inDelphi") in conjunction with a double-strand break (DSB)-inducing genome editing system to edit a nucleotide sequence (e.g., a genome) to achieve a desired genetic outcome (e.g., a correction to a disease-causing mutation to treat a disease, or modification of a wildtype type gene to confer an improved trait or phenotype). For any given set of inputs (a context sequence and a selected cut site), the trained computational model computes the probability distribution of indel lengths and the probability distribution of genotype frequencies, enabling the user to select the optimal input (e.g., cut site) for conducting editing by a DSB-inducing genome editing system to achieve the highest frequency of desired genetic output. The computational method may be used to predict, for a given local sequence context, template-free repair genotypes and frequencies of occurrence thereof.
Figure 25D:
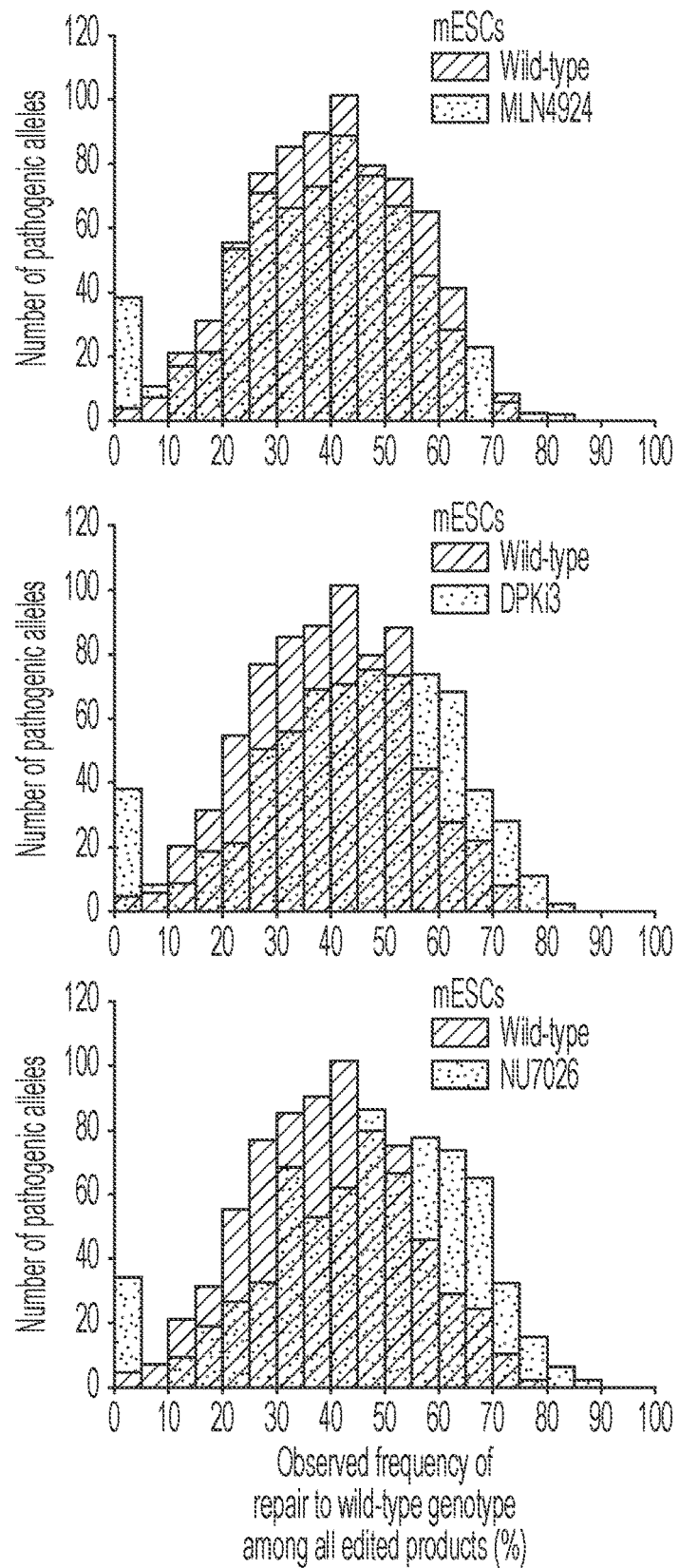
Figure 26A:
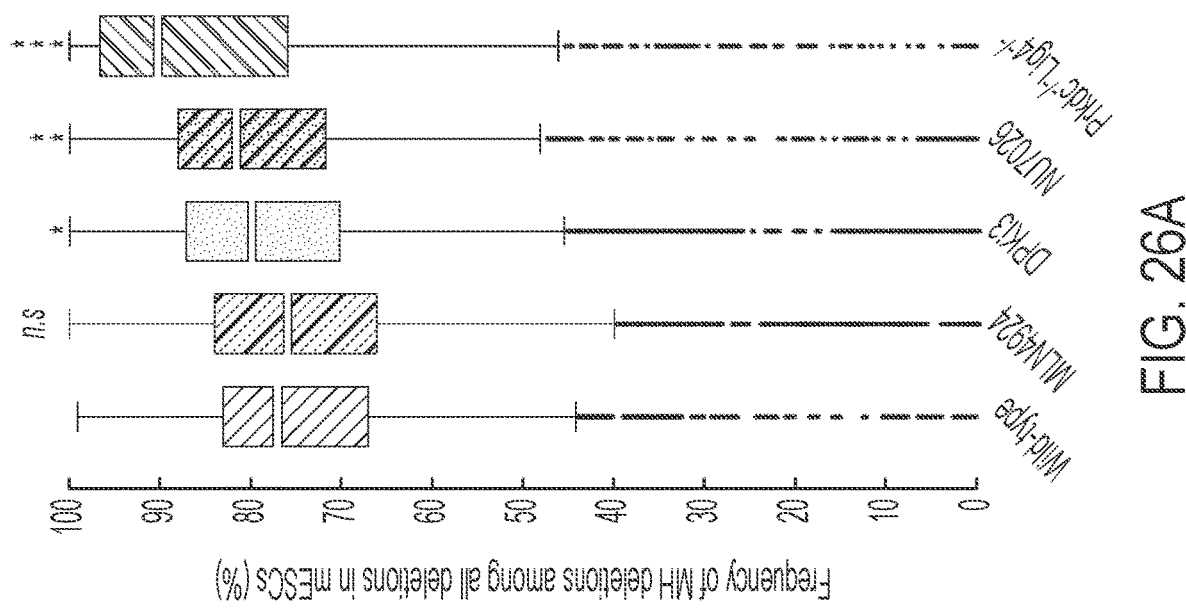
Figure 26B:
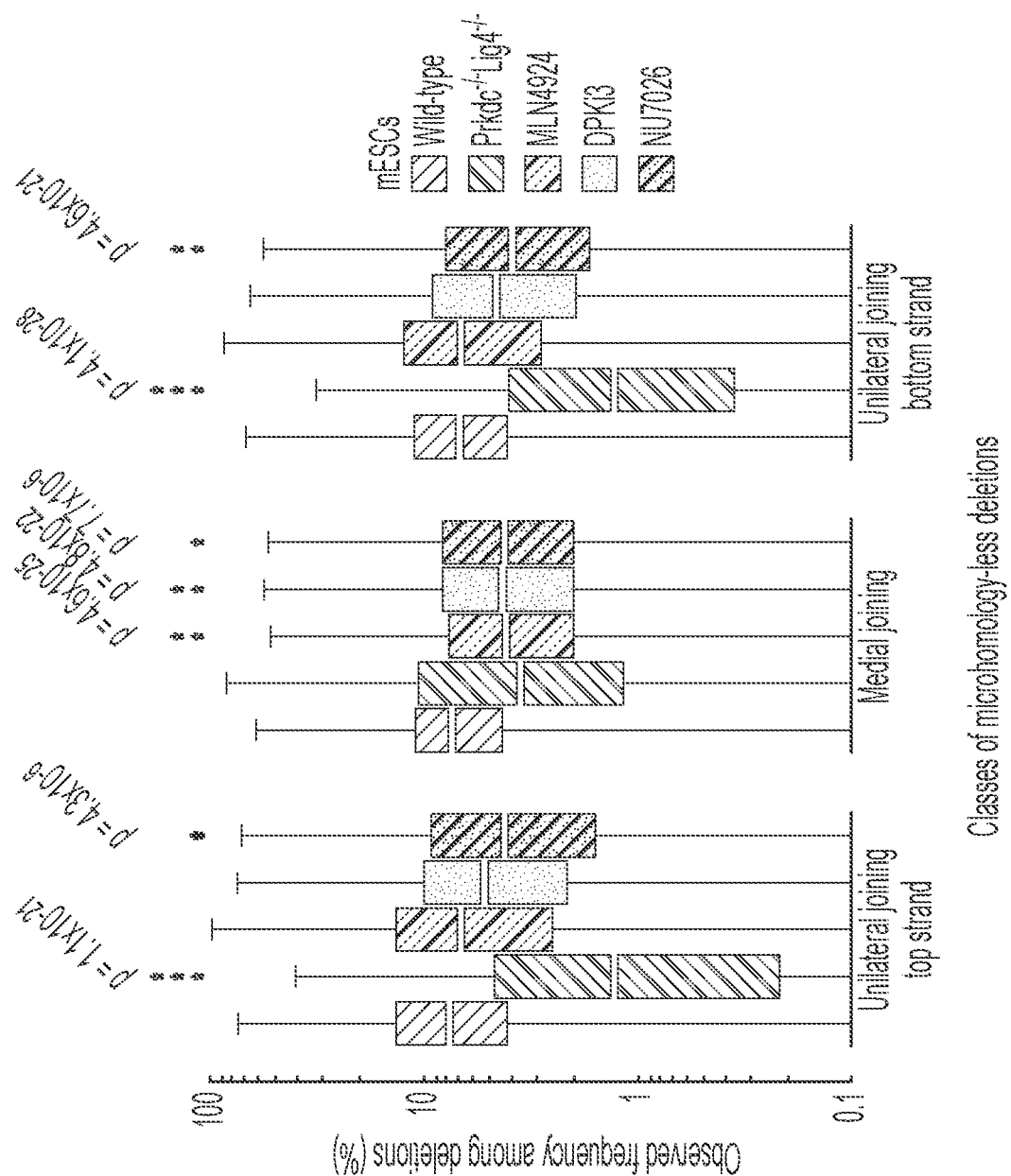
Figure 26C:
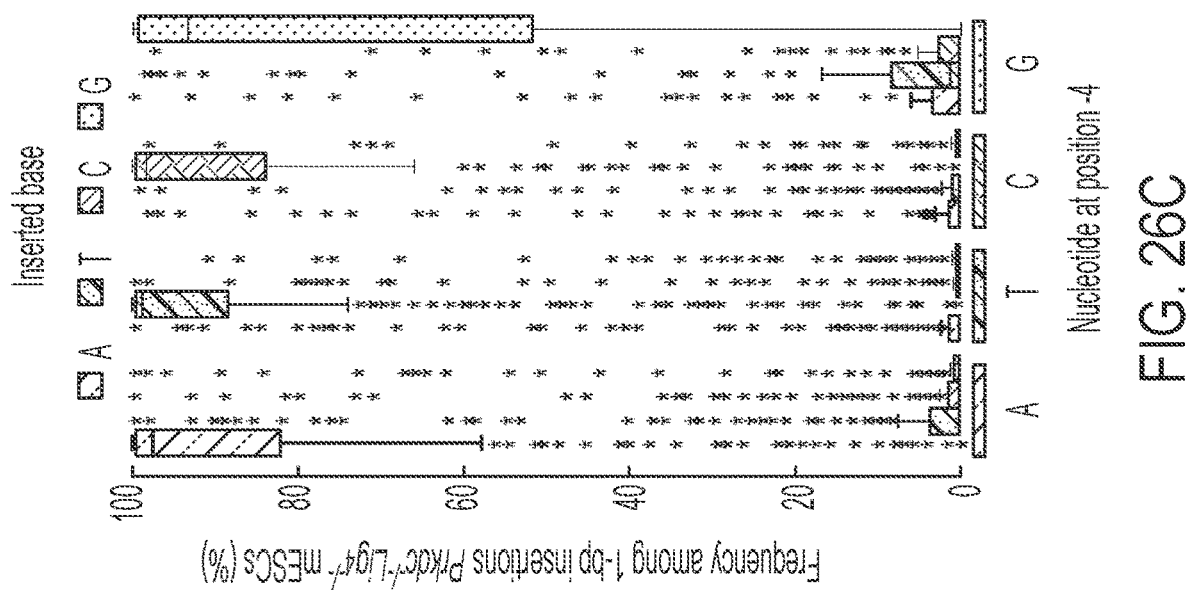
Figure 26D:
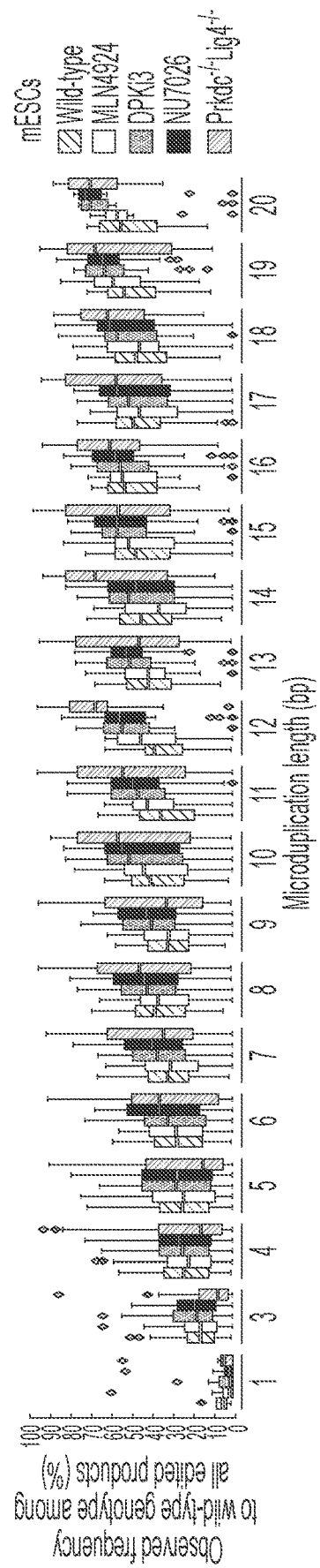
Figures 26F, 26G:
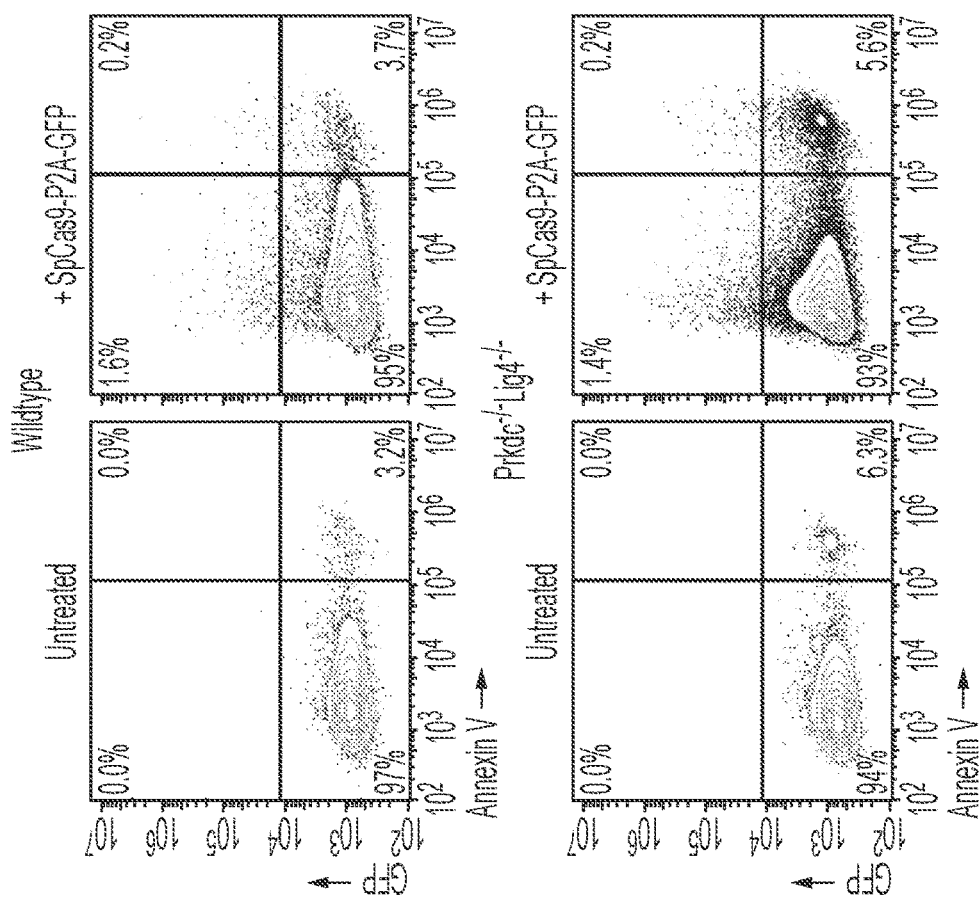

To capture Cas9-mediated end-joining repair products across a wide variety of target sequences, a genome-integrated gRNA and target library screen was designed in which many unique gRNAs are paired with corresponding 55-bp target sequences containing a single canonical "NGG" SpCas9 protospacer-adjacent motif (PAM) that directs cleavage to the center of each target sequence (FIG. 11A). To explore repair products among sequences representative of the human genome, 1,872 target sequences were computationally designed that collectively span the human genome's distributions of % GC, number of nucleotides participating in microhomology, predicted Cas9 on-target cutting efficiency[4], and estimated precision of deletion products[24] (FIGS. 16A-16C). Through a multi-step process (FIGS. 16A-16C), the library (Lib-A—see Table 4) was cloned into a plasmid backbone allowing Tol2 transposon-based integration into the genome[25], gRNA expression, and hygromycin selection for cells with genomically integrated library members.

Lib-A was stably integrated into the genomes of mouse embryonic stem cells (mESCs). Next, these cells were targeted with a Tol2 transposon-based SpCas9 expression plasmid containing a blasticidin expression cassette and selected for cells with stable Cas9 expression. Sufficient numbers of cells were maintained throughout the experiment to ensure >2,000-fold coverage of the library. After one week, genomic DNA was collected from three independent replicate experiments from these cells and performed paired-end high-throughput DNA sequencing (HTS) using primers flanking the gRNA and the target site to reveal the spectrum of repair products at each target site. Using a sequence alignment procedure, the resulting 96,838,690 sequence reads were tabulated into observed frequencies of, on average, 1,262 unique repair genotypes for each target site.

To test the correspondence between library repair products and endogenous repair products, Lib-A included the 55-bp sequences surrounding 90 endogenous genomic loci for which the products of Cas9-mediated repair were previously characterized by HTS[24]. Previously reported repair products from this endogenous dataset (VO) in three human cell lines (HCT116, K562, and HEK293) reveal that 94% of endogenous Cas9-mediated deletions are 30 bp or shorter (FIGS. 16A-16C), suggesting that the Lib-A analysis method is capable of assessing the vast majority of Cas9-mediated editing products. It was found that repair outcomes for these Lib-A members corresponding to the VO sites in mESCs are consistent with previously reported endogenous repair products in human cells (median r=0.76, FIGS. 17A-17D). Lib-A repair genotype frequencies are also consistent between experimental replicates (median r=0.89, FIGS. 17A-17D), confirming that Cas9-mediated editing products of the target library reflect previously reported endogenous target locus editing products in human cells.

In Lib-A data from mESCs and in the three VO datasets from endogenous HEK293, K562, and HCT116 cells, end-joining repair of Cas9-mediated double-strand breaks primarily causes deletions (73-87% of all products) and insertions (13-25% of all products) (FIGS. 11B, 11C, FIGS. 17A-17D). Rarer Cas9-mediated repair products were also detected such as combination insertion/deletions (0.5-2% of all products) and deletions and insertions distal to the cutsite (3-5% of all products), which occur more often on the PAM-distal side of the double-strand break (FIGS. 17A-17D). The majority of products are deletions containing microhomology consistent with MMEJ (53-58% of all products, and 70-75% of deletions) (FIGS. 11B, 11C, FIGS. 17A-17D for a definition of microhomology-containing deletions).

Figure 11B:
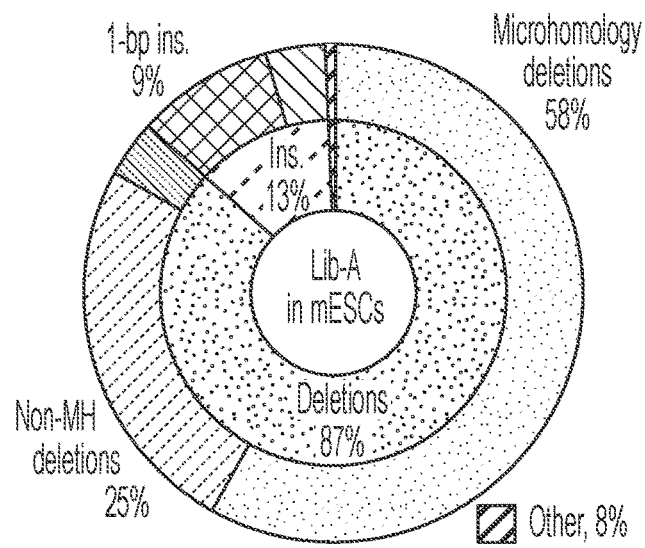
Figure 11C:
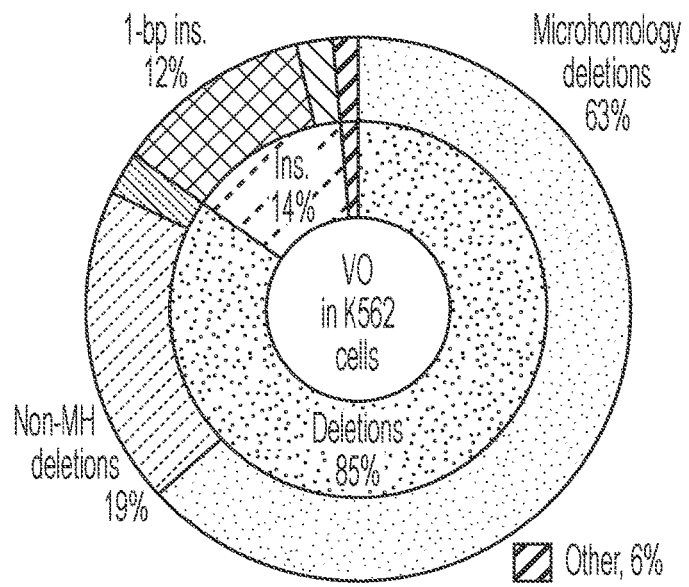
Figure 12A:
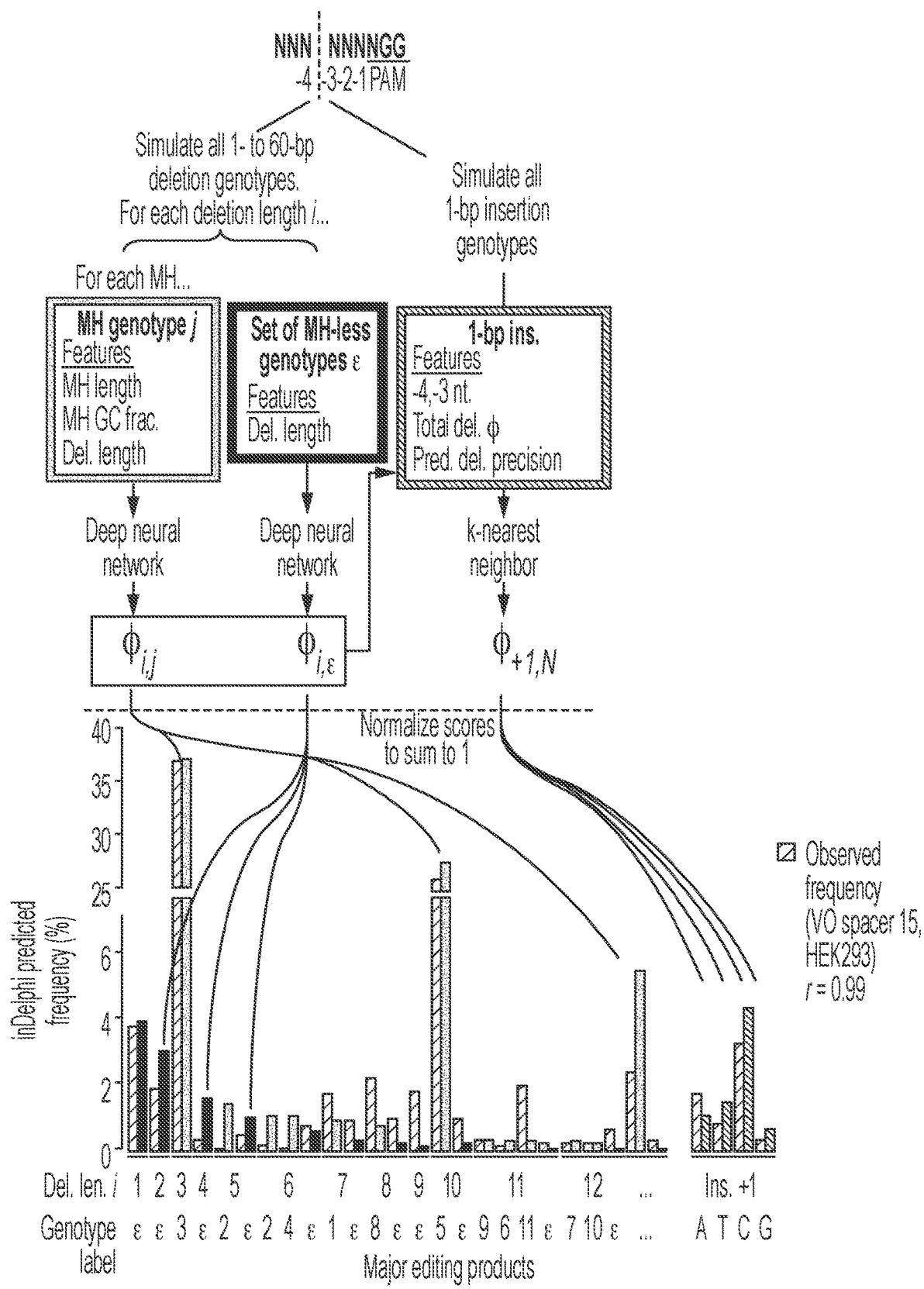
FIGS. 12A-12E show modeling of Cas9-mediated indels by inDelphi.
Figure 12B:
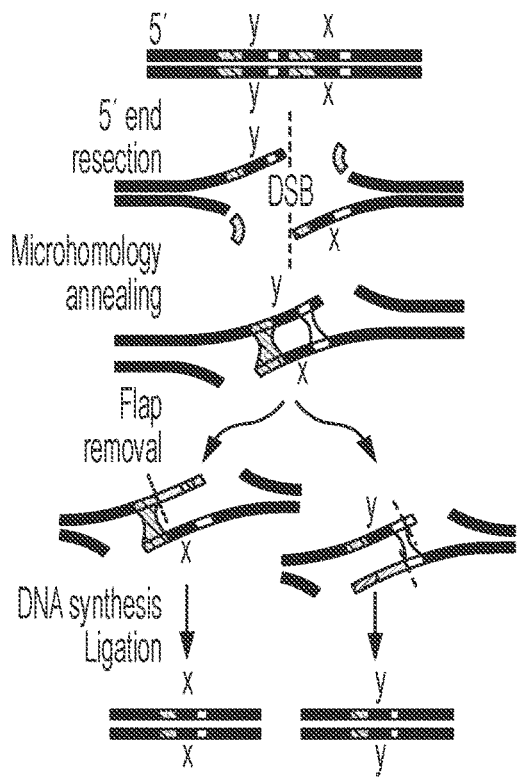

Using the wealth of Cas9 outcome data provided by Lib-A, a novel machine learning model, inDelphi, was trained to predict the spectrum of Cas9-mediated editing products at a given target site. This model consists of three interconnected modules aimed at predicting the three major classes of repair outcomes: microhomology deletions (MH deletions), microhomology-less deletions (MH-less deletions), and single-base insertions (1-bp insertions, FIG. 12A). These three repair classes are defined as constituting all major editing outcomes and note that they comprise 80-95% of all observed editing products (FIGS. 11B, 11C). Motivated by the abundance of MH deletion products in Lib-A and VO data, a deep neural network was designed to predict MH deletions as one module of inDelphi. This module simulates MH deletions using the MMEJ repair mechanism, where 5'-to-3' end resection at a double-strand break reveals two 3' ssDNA overhangs that can anneal through sequence microhomology. Extraneous ssDNA overhangs are eliminated, and DNA synthesis and ligation generates a dsDNA repair product[26] (FIG. 12B). Through this mechanism, each potential microhomology results in a distinct deletion genotype, allowing a 1:1 mapping between possible microhomologies at a target site and available MH deletion outcome genotypes (FIG. 12B). inDelphi models MH deletions as a competition between different MH-mediated hybridization possibilities. Using the input features of MH length, MH % GC, and deletion length, inDelphi outputs a score (phi) reflecting the predicted strength of each microhomology (FIG. 12A). From training data, inDelphi learned that strong microhomologies tend to be long and have high GC content (FIGS. 18A-18H).

To account for all deletions that cannot be simulated through the MMEJ mechanism, inDelphi also contains a second neural network module that predicts the distribution of MH-less deletion lengths using the minimum required resection length as the only input feature (FIG. 12A). Because there are many MH-less genotypes for each deletion length with frequencies that do not fit a simple pattern, inDelphi predicts the frequencies of deletion lengths but not of genotypic outcomes for MH-less deletions. This module learned from training data that the frequency of MH-less deletions decays rapidly with increasing length (FIGS. 18A-18H). It is hypothesized that MH-less deletions arise primarily from the activity of the classical and alternative NHEJ pathways[27]. The two neural networks were jointly trained using observed distributions of deletion genotypes from 1,095 Lib-A target sites (FIG. 12A).

Figure 12C:
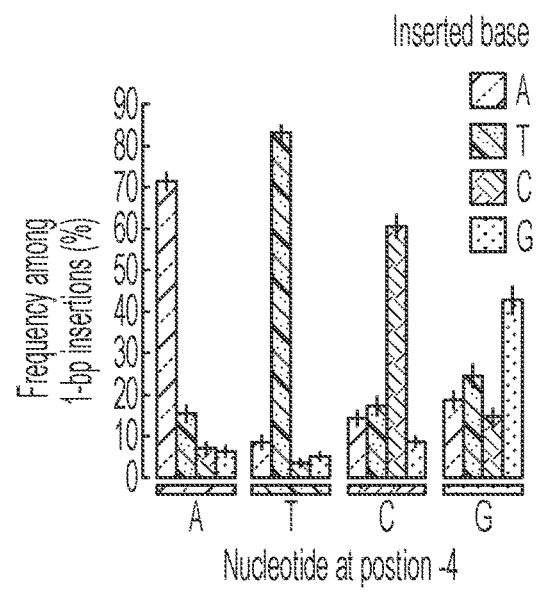
Figure 12D:
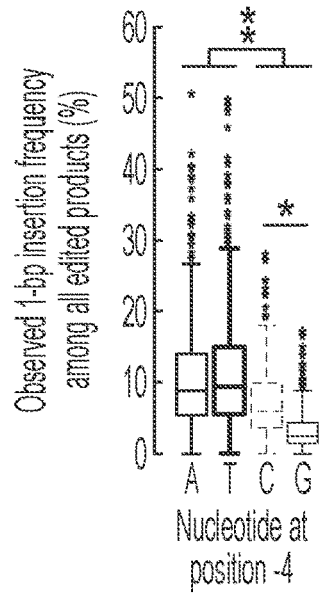
Figure 12E:
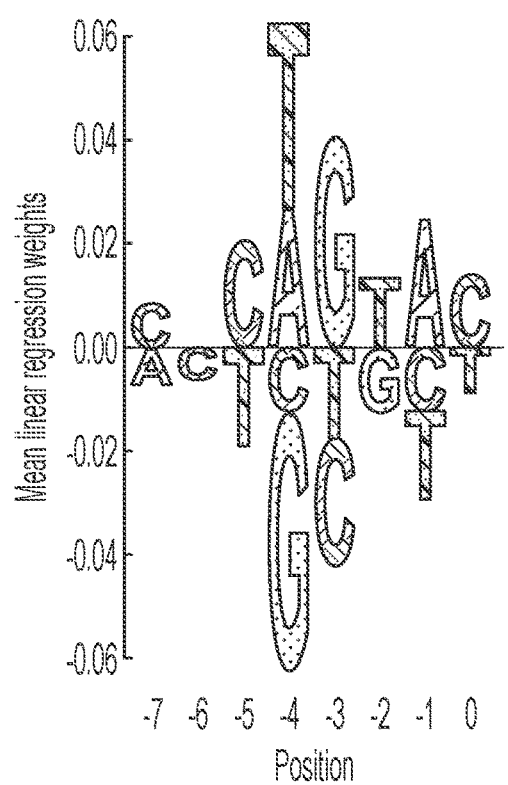

The inDelphi model contains a third module to predict 1-bp insertions (FIG. 12A). In VO and Lib-A data, insertions represent a major class of DNA repair at Cas9-mediated double-strand breaks (13-25% of all products, FIGS. 11B, 11C, FIGS. 17A-17D). Among insertions, 1-bp insertions are dominant (9-21% of all products, FIGS. 11B, 11C, FIGS. 17A-17D). Surprisingly, it was found that the frequency of 1-bp insertions and their resultant genotypes depend strongly on local sequence context. In endogenous and library settings, 1-bp insertions predominantly comprise duplications of the −4 nucleotide (counting the NGG PAM as nucleotides 0-2, FIG. 12A), with higher precision when the −4 nucleotide is an A or T and with lower precision when it is a C or G (FIG. 12C). While 1-bp insertions were observed occurring in 9% of products on average in Lib-A, this frequency varies significantly depending on the nucleotide at position −4, falling to less than 4% on average when the −4 nucleotide is G (FIG. 12D, $P<10^{-34}$). While position −4 is most strongly associated with 1-bp insertion frequency, other surrounding bases also contribute to insertion frequency (FIG. 12E). In addition, it was found that target sites with poor microhomology (low total phi score) and target sites with imprecise deletion product distributions are more likely to contain insertions at the expense of deletions (FIGS. 18A-18H). Based on these empirical observations, inDelphi models insertions and deletions as competitive processes in which the total deletion phi score (overall microhomology strength) and predicted deletion precision influence the relative frequency of 1-bp insertions, and the local sequence context influences the relative frequency and genotypic outcomes of 1-bp insertions (FIG. 12A). inDelphi integrates these factors into predictions of 1-bp insertion genotype frequencies using a k-nearest neighbor approach. Collectively, from sequence context alone, inDelphi predicts the indel lengths of 80-95% of Cas9-mediated editing products and the single-base resolution genotypes of 65-80% of all products (FIG. 13A, FIGS. 19A-19D).

Figure 13A:
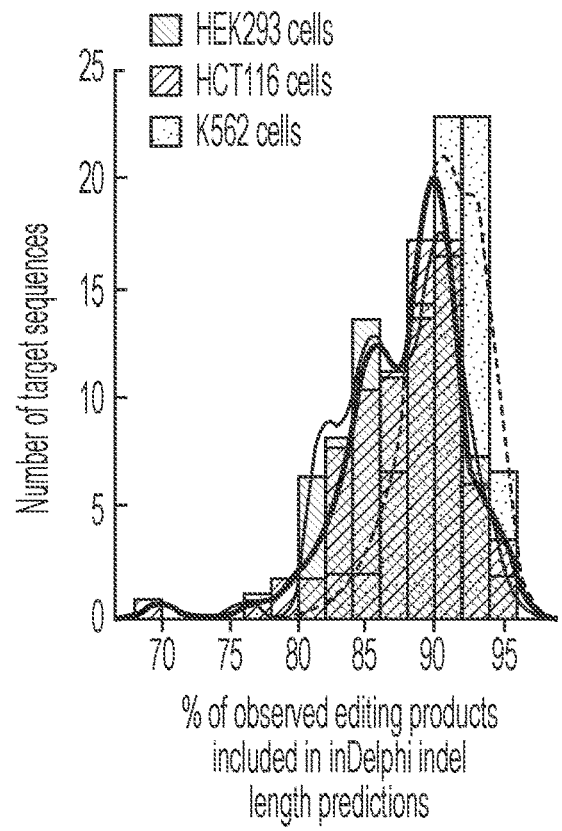
FIGS. 13A-13F show that Cas9-mediated editing outcomes are accurately predicted by inDelphi.
Figure 13B:
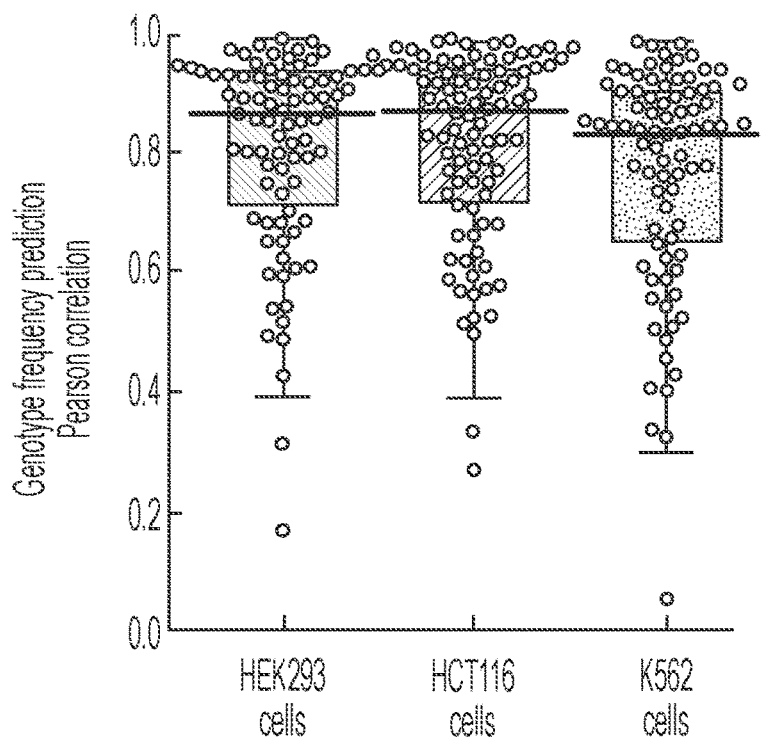
Figure 13C:
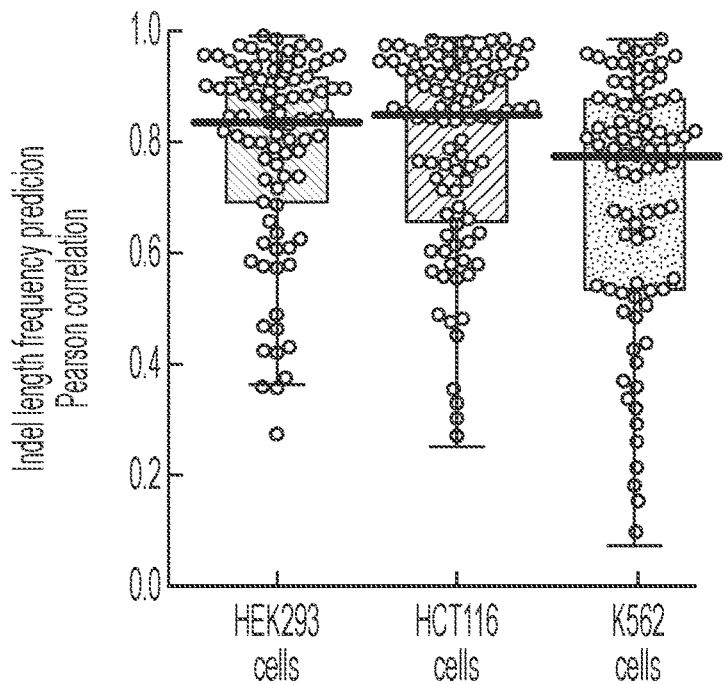

Trained on data from 1,095 Lib-A sequence contexts in mESCs, inDelphi demonstrates highly accurate genotypic prediction of 1-bp insertions and 1-60-bp deletions at 87-90 VO target sequences previously characterized experimentally in endogenous K562, HCT116, and HEK293 cells (median $r=0.87$, FIG. 13B). It is noted that the Lib-A versions of these target sites were held out of inDelphi training. The inDelphi model also performs well when predicting indel length distributions from 1-bp insertions to 60-bp deletions at the endogenous VO sites in three human cell lines (median $r=0.84$, FIG. 13C). Additionally, inDelphi accurately predicts relative frequencies of genotypic outcomes (median $r=0.94$) and indel length distributions (median $r=0.91$) of 189 held-out Lib-A targets in mESCs (FIGS. 19A-19D). As a control that the features used in training inDelphi are crucial for its performance, the MH length feature was deleted from the inDelphi MH deletion module and found that inDelphi's performance predicting genotype frequency was reduced to the performance of a model with random weights. A second control in which the deep neural networks were replaced with linear models showed 10-24% reduced performance on the genotype frequency and indel length prediction tasks. Together, these controls indicate that inDelphi's computational structure is important for its accuracy. An online implementation of inDelphi is provided to predict the spectrum of Cas9-mediated products at any target site (crisprindelphi.design). Taken together, these results establish that in data from human and mouse cells, the relative frequencies of most Cas9 nuclease-mediated editing outcomes are highly predictable.

Figure 13D:
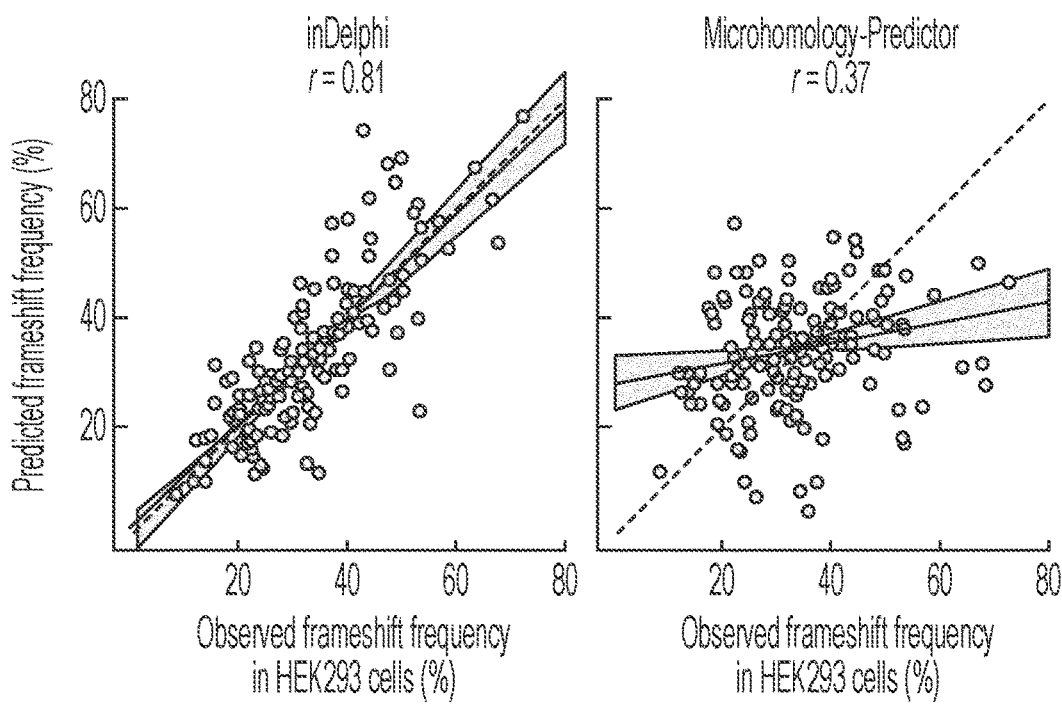
Figure 13E:
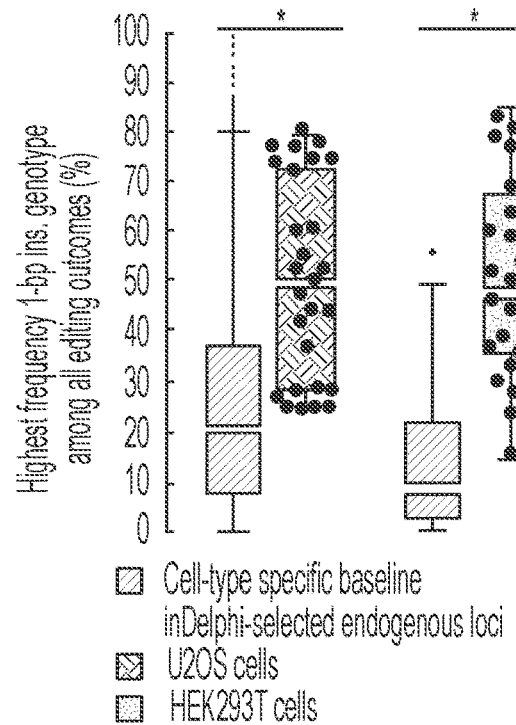
Figure 13F:
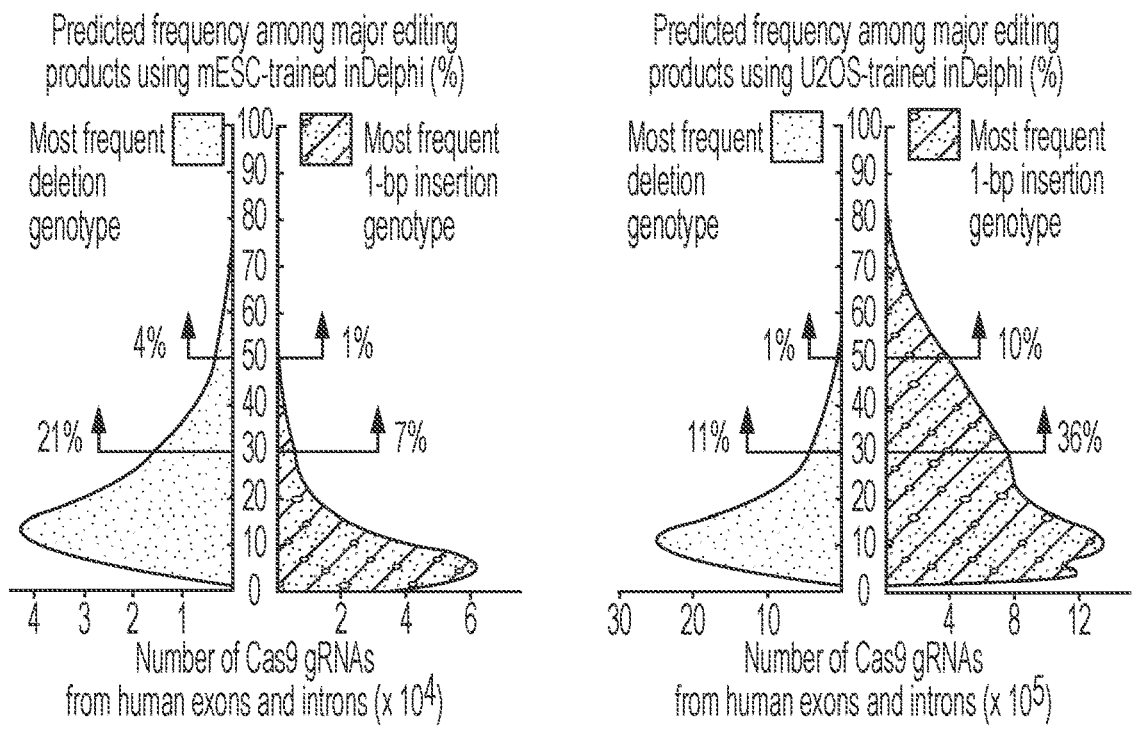

The ability of Cas9-mediated end-joining repair to induce frameshifts enables efficient gene knockout[28]. It was reasoned that inDelphi's accurate prediction of the indel length distribution of 80-95% of template-free Cas9-mediated editing products should also enable accurate prediction of Cas9-induced frameshifts. This task was simulated in 86 endogenous VO target sequences in HEK293 by tabulating the observed frequency of indels resulting in +0, +1, and +2 frameshifts. The observed frequency of indels in each frame predicted by inDelphi (median $r=0.81$) compare favorably to those generated by Microhomology Predictor (median $r=0.37$), a previously published method[29] (FIG. 13D). Thus, it is expected that inDelphi facilitates Cas9-mediated gene knockout approaches by allowing a priori selection of gRNAs that induce high or low knockout frequencies. To this end, an online tool is provided to predict frameshift frequencies for any SpCas9 gRNA targeting the coding human and mouse genome (crisprindelphi.design). It is noted that human exons have a significant tendency ($p<10^{-100}$, FIGS. 19A-19D) to favor frame-preserving deletion repair compared to shuffled exon sequences or non-coding human DNA. Taken together, the results show that inDelphi provides accurate single-base resolution predictions for the relative frequencies of most Cas9 nuclease-mediated end-joining repair outcomes, including frameshifts.

Designing High-Precision Template-Free Cas9 Nuclease-Mediated Editing

While end-joining repair is highly efficient at inducing mutations after Cas9 treatment, its tendency to induce a heterogeneous mixture of repair genotypes has limited its application primarily to gene disruption and removal of intervening sequences between two double-stranded breaks30-33. Motivated by inDelphi's ability to predict Cas9-mediated repair outcomes from target sequences alone, it was sought to identify target sites for which the repair profile is highly skewed toward a single outcome. In principle, the ability of inDelphi to identify such sites may enable efficient, template-free, nuclease-mediated precision gene editing.

Figure 14B:
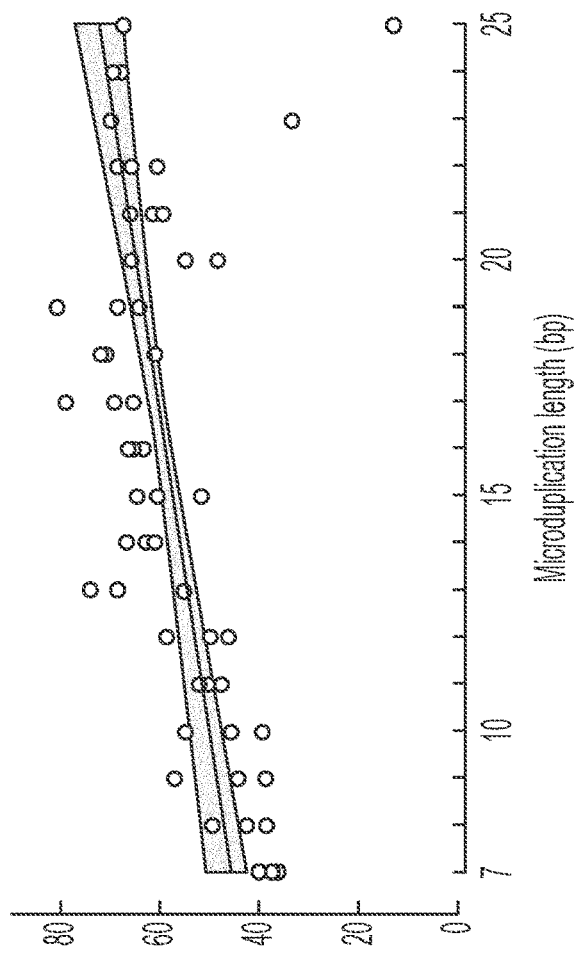
FIGS. 14A-14F show high-precision, template-free Cas9 nuclease-mediated deletion and insertion.
Figure 14A:
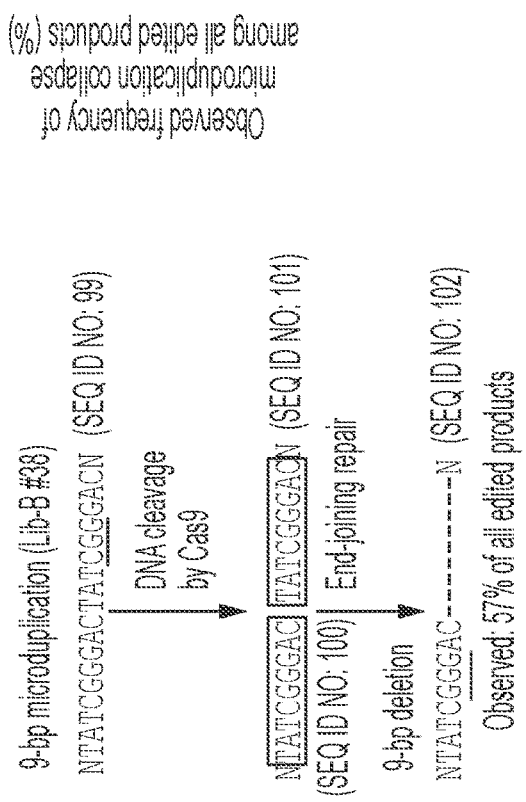

It was reasoned that a single strong microhomology hybridization possibility with a high phi score would outcompete a background of weaker alternative microhomologies to yield efficient and precise repair to a single deletion genotype. Microduplications, in which a stretch of DNA is repeated in tandem, contain stretches of exact microhomology and thus are predicted by inDelphi to collapse precisely through deletion upon MMEJ repair (FIG. 14A).

To test this prediction, a second high-throughput Cas9 substrate library (Lib-B—see Table 5) was designed and constructed that contains three families of target sequences with microduplications of each length from 7-25 bp. Cas9-mediated double-strand break repair products were analyzed in Lib-B in mESCs and in human U2OS and HEK293T cells using the same procedure as for Lib-A evaluation. Highly precise repair was consistently observed in which 40-80% of all repair events correspond to a single repair genotype (FIG. 14B), substantially higher than the 21% median frequency of the most abundant deletion genotype in 90 VO sites that were not pre-selected for microhomology. The fraction of microduplication repair to a single collapsed product as compared to other outcomes increased with microduplication length in mESCs, U20S, and HEK293T cells ($r=0.35$, $p<7\times10^{-5}$, FIG. 14B, FIGS. 20A-20E). It is noted that these sites have significantly higher phi scores and precision scores compared to VO sites, and significantly fewer 1-bp insertions (FIGS. 20A-20E). Thus, sites with strong MH deletion candidates are enriched in that specific deletion outcome at the expense of MH-less deletion and 1-bp insertion outcomes.

Figure 14C:
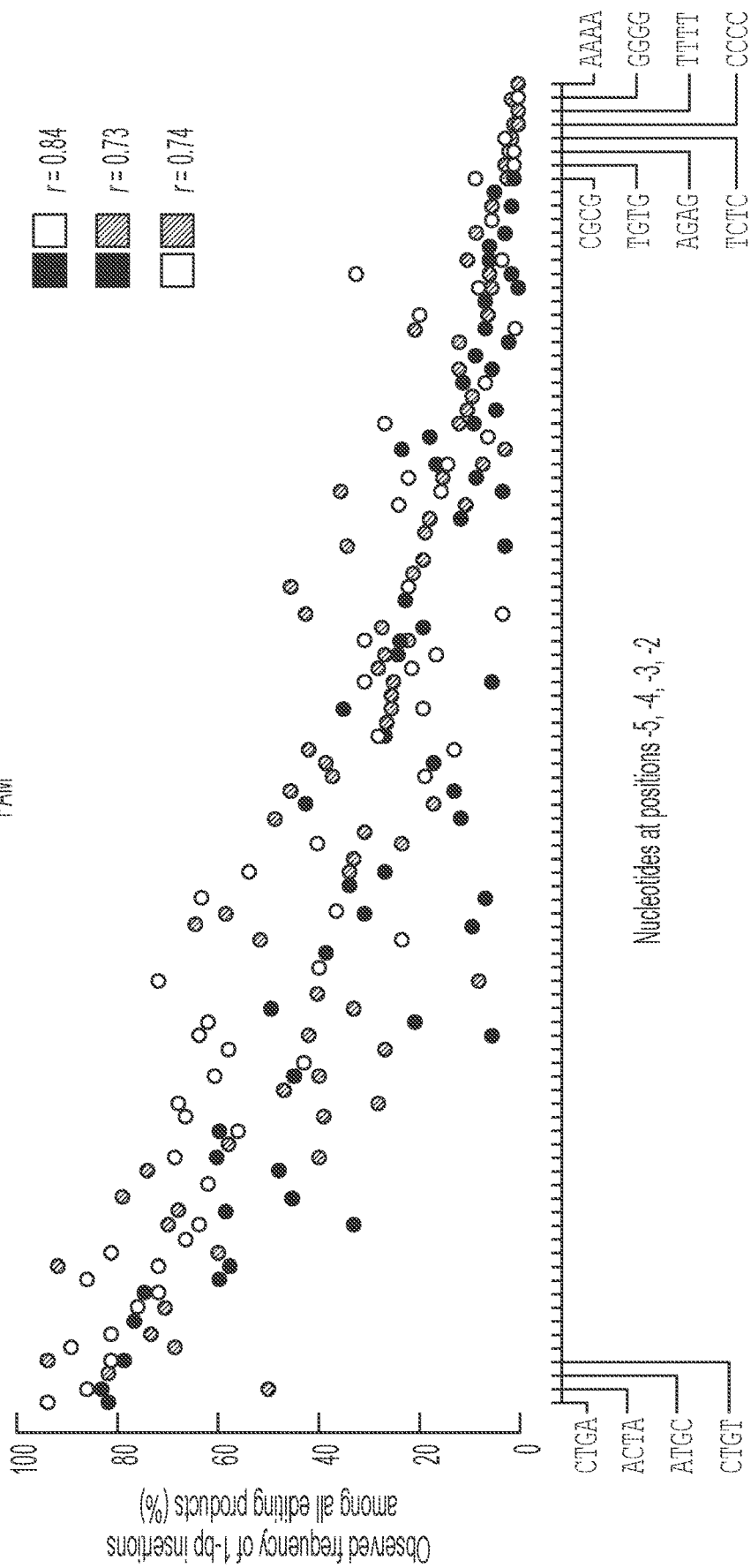
Figure 14E:
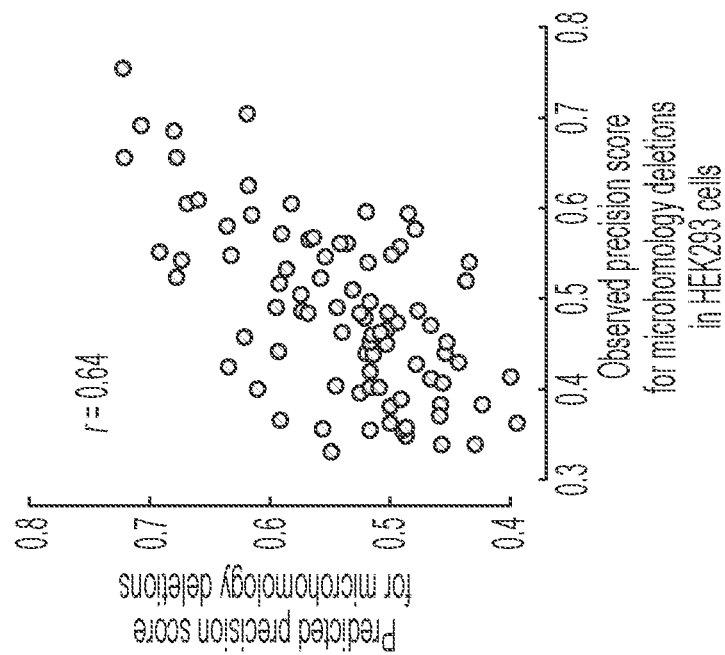
Figure 14D:
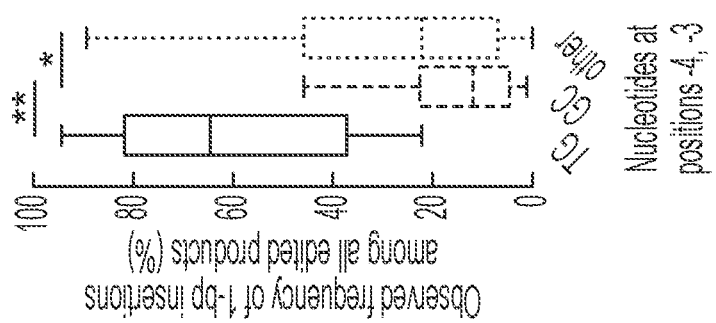

It is also hypothesized that sequence contexts with no strong MHs (low total phi scores) could enable precise 1-bp insertion repair. To test this possibility, three target sequence frameworks with low total phi scores were included in Lib-B (FIGS. 20A-20E) containing randomization at the four positions surrounding the Cas9 cleavage site (positions −5 to −2 with respect to the PAM at positions 0-2; see FIG. 12A). Cas9 nuclease treatment of 205 such sequences in Lib-B resulted in highly precise (up to 90% of all repair events) and reproducible (r=0.90 between mESC replicates) 1-bp insertions (FIG. 14C, FIGS. 20A-20E). Strikingly, the efficiency of 1-bp insertions is strongly influenced by the nucleotide identities in positions −5 to −2 (FIG. 14C). Similar to the findings from Lib-A (FIG. 12E, FIGS. 20A-20E), −4T and −3G correlate with higher relative frequencies of 1-bp insertion among all products while −4G correlates with lower frequencies of insertion (FIG. 14D). Among these three fixed sequence contexts in Lib-B with low total MH, 1-bp insertions comprise a median of 29% of all repair products, which is significantly higher than in VO sites (FIGS. 20A-20E). Moreover, a median of 61% of all products are 1-bp insertions at sites with TG at the −4 and −3 positions (FIG. 14D), revealing that precise 1-bp insertion can be obtained through Cas9-mediated end-joining at specific, predictable sequence contexts.

It is noted that sequences that support higher insertion efficiencies (>50%) have on average 33% lower total efficiencies of Cas9-mediated indels than sequences that yield lower insertion efficiencies (r=−0.35, p=3.3×10⁻⁷, FIGS. 20A-20E), possibly because the lower efficiency of MMEJ at such sites decreases the likelihood of mutagenic repair of the Cas9-induced double-strand break. These observations collectively establish that Cas9-mediated repair of target sites with predictable sequence features can lead to precise editing favoring one particular outcome.

Based on these findings, inDelphi was used to predict gRNAs that lead to such precise outcomes. A metric was defined using information entropy to measure the precision of a repair outcome spectrum as a score ranging from zero (highest entropy, lowest precision) to one (lowest entropy, highest precision) and demonstrated that inDelphi is capable of predicting the precision of Cas9-induced deletions in 86 VO target sequences in HEK293 cells (median r=0.64, FIG. 14E). inDelphi was then used to discover SpCas9 gRNAs that support precise end-joining repair in the human genome.

Figure 14F:
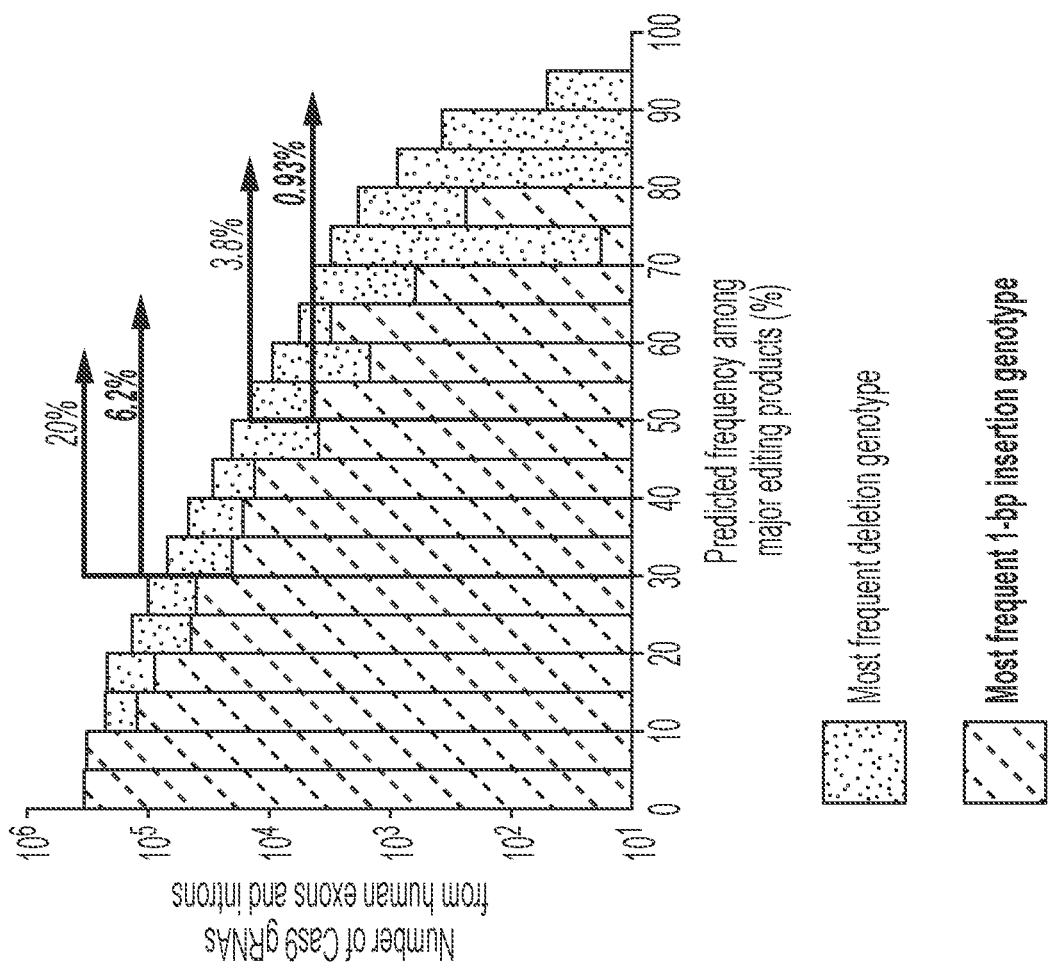

It was found that substantial fractions of all genome-targeting SpCas9 gRNAs are predicted to produce relatively precise outcomes (Table 2). Indeed, inDelphi predicts that 26% of SpCas9 gRNAs that target human exons and introns are "precision gRNAs" (FIG. 14F), which are defined as gRNAs predicted to produce a single genotypic outcome in >30% of all major editing products, with 20% of gRNAs predicted to be produce a single deletion genotype at ≥30% efficiency and 6.2% predicted to produce a single 1-bp insertion genotype at >30% efficiency. Moreover, inDelphi predicts that 4.8% of SpCas9 gRNAs targeting human exons and introns are "high-precision gRNAs," which are defined as gRNAs that produce a single genotype in ≥50% of all major editing products (FIG. 14F, 3.8% producing high-precision deletion, 0.94% producing high-precision 1-bp insertion). These findings suggest that Cas9-mediated end-joining outcomes at many target sites are both predictable and precise, and that precision and high-precision gRNAs offer new opportunities for precision deletion and insertion by Cas9 nuclease-mediated editing. An online tool is provided to predict the precision of a given gRNA and to identify precision and high-precision SpCas9 gRNAs targeting the human and mouse genomes (crisprindelphi.design).

Efficient Template-Free Repair of Pathogenic Alleles to Wild-Type Genotypes

Figures 15A, 15B:
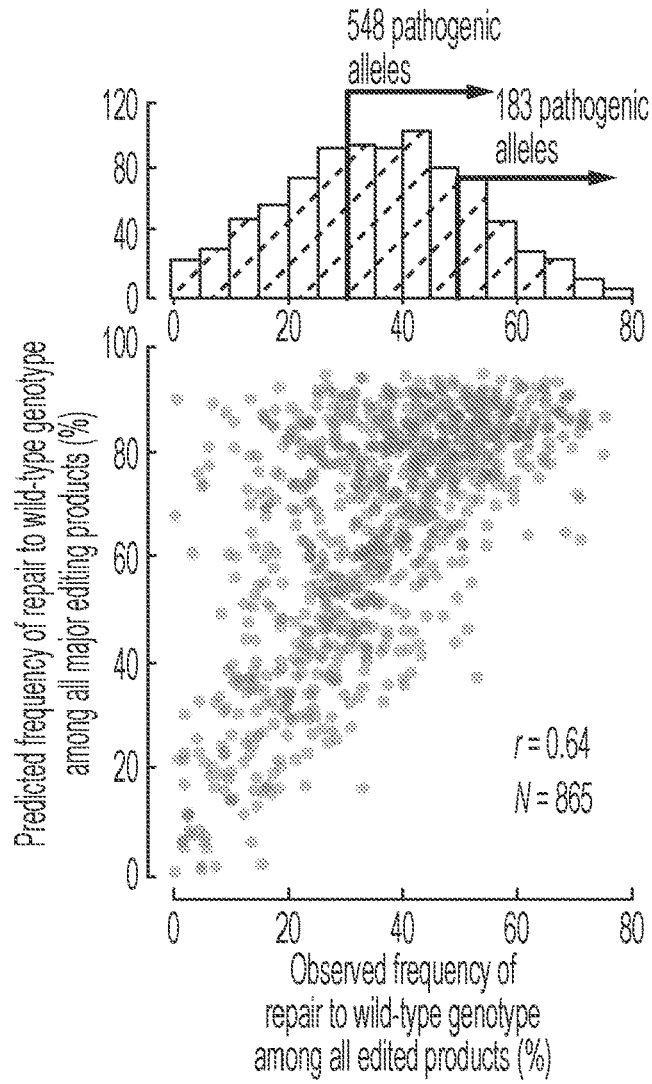
FIGS. 15A-15F show precise template-free Cas9-mediated editing of pathogenic alleles to wild-type genotypes.

Next, inDelphi-classified high-precision gRNAs were used to identify new targets for therapeutic genome editing. Starting with 23,018 insertion, short deletion, and microduplication disease genotypes from the ClinVar and HGMD databases[16,17], inDelphi was tasked with identifying pathogenic alleles that are suitable for template-free Cas9-mediated editing to effect precise gain-of-function repair of the pathogenic genotype. Two genetic disease allele categories that have not been previously identified as targets for Cas9-mediated repair are predicted by inDelphi to be candidates for high-precision repair. The first category is a selected subset of pathogenic frameshifts in which, because of high-precision repair, inDelphi predicts that 50-90% of Cas9-mediated deletion products will correct the reading frame compared to the average frequency of 34% among all disease-associated frameshift mutations. The second category is pathogenic microduplication alleles in which a short sequence duplication leads to a frameshift or loss-of-function protein sequence changes (FIG. 15A).

Figure 15C:
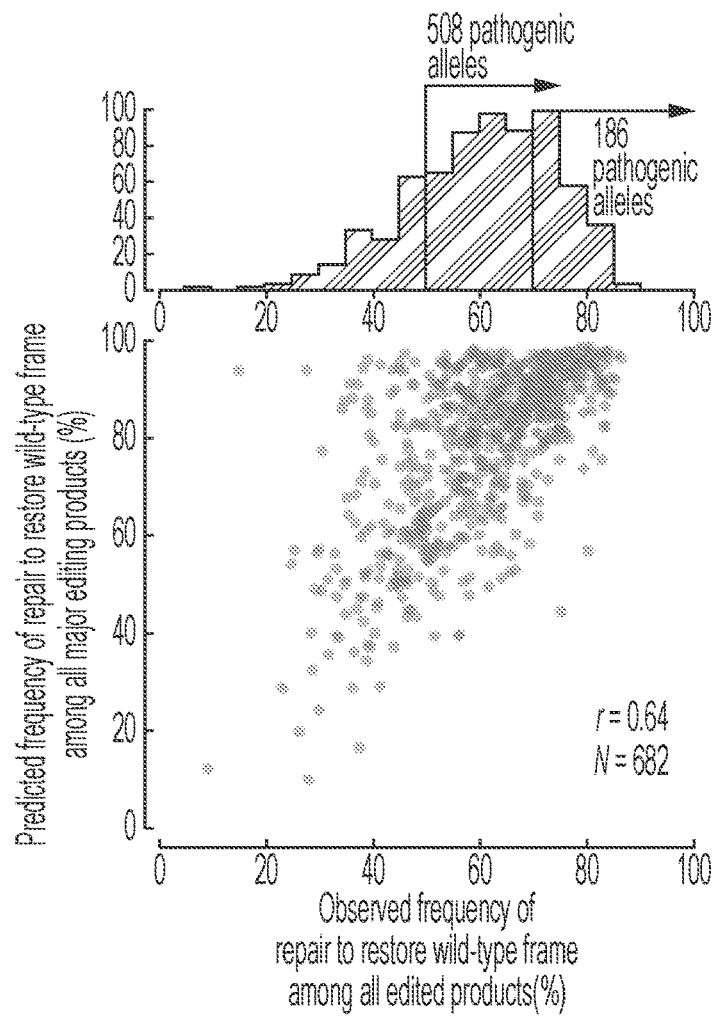

To test the accuracy of inDelphi at predicting repair genotypes of therapeutically relevant alleles, 1,592 pathogenic human loci that inDelphi identified to have the highest predicted rates of frameshift or microduplication repair to the wild-type sequence, were included in Lib-B. Cas9-mediated repair of genome-integrated Lib-B in mESCs and human U2OS and HEK293T cells confirmed highly efficient and precise gain-of-function editing. It was observed that 183 human disease microduplication alleles included in Lib-B were repaired to wild-type in ≥50% of all products FIG. 15B), and 508 pathogenic human frameshift alleles were restored into proper reading frame in ≥50% of all products in mESCs (FIG. 15C), in agreement with inDelphi's predictions (r=0.64 for frame restoration, r=0.64 for wildtype repair). Similar results were observed in HEK293T and U2OS cells (FIGS. 21A-21D). While microduplication repair to the wild-type genotype unambiguously restores wild-type protein function, it is noted that frameshift restoration that alters coding sequence requires case-by-case analysis to validate rescue of protein function.

Figure 15D:
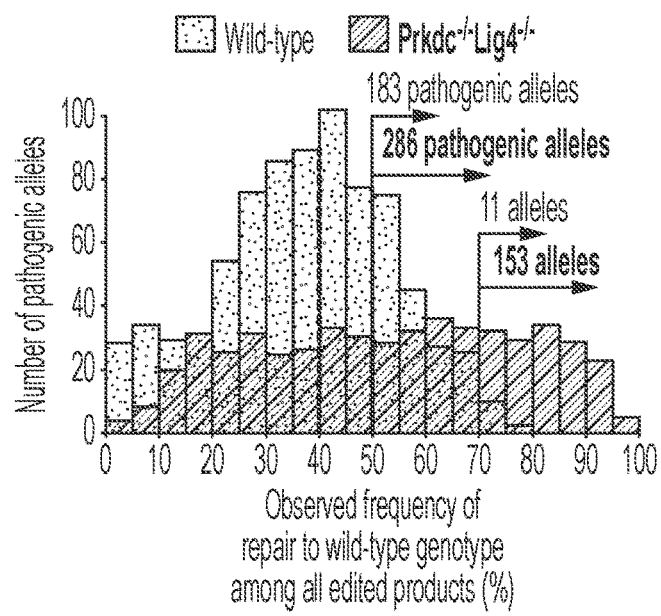
Figure 15E:
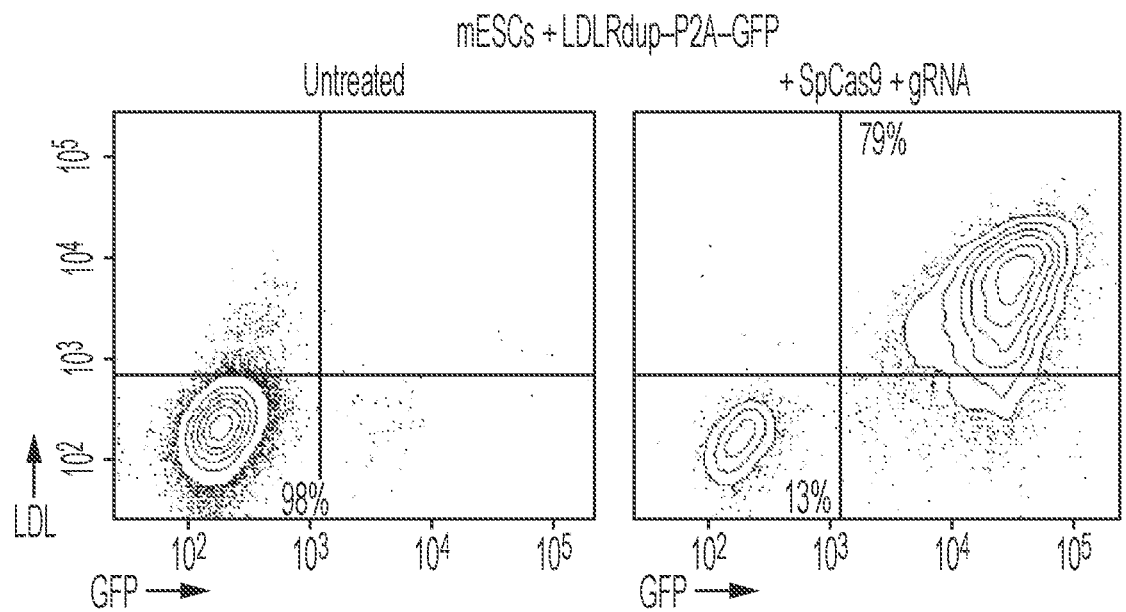
Figure 15F:
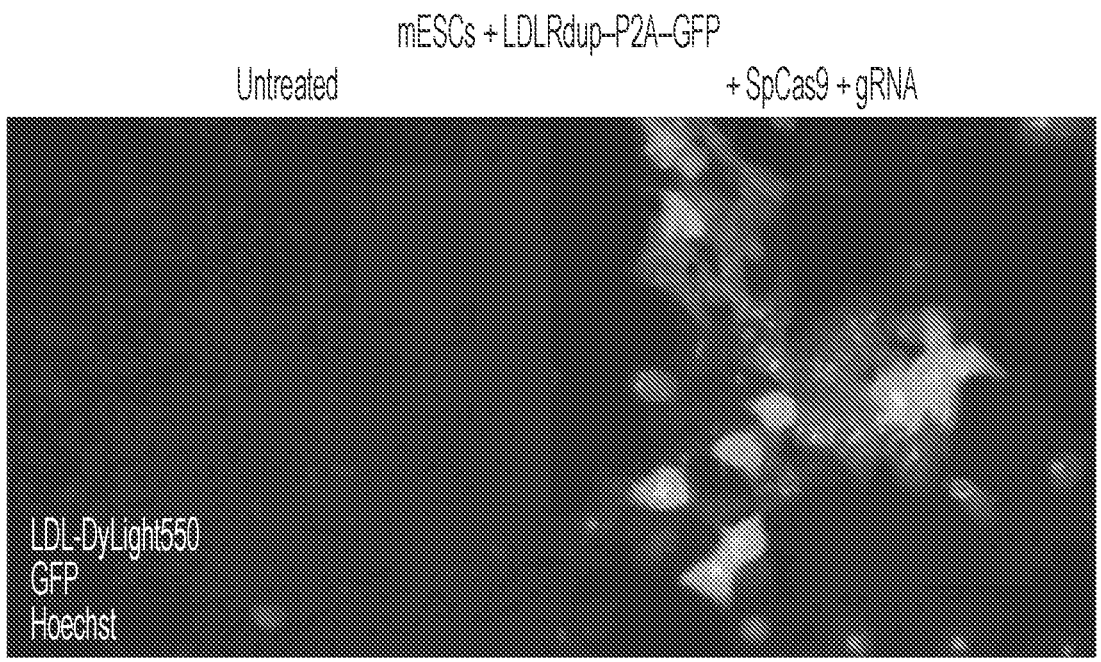

To determine if the efficiency of microduplication repair can be increased by manipulation of DNA repair pathways, Cas9 cleavage of Lib-B was performed in Prkdc⁻/⁻Lig4⁻/⁻ mESCs[34], which are deficient for two proteins involved in NHEJ repair[35]. As expected, the frequency of MH-less deletion repair in cells with impaired NHEJ is decreased (25% to 16%) (FIGS. 22A-22E). It was also observed that the precision of 1-bp insertions that result in duplication of the −4 nucleotide is increased in Prkdc⁻/⁻Lig4⁻/⁻ mESCs (FIGS. 22A-22E). Importantly, the frequency of MH-dependent deletion repair is substantially increased (58% to 72%) in Prkdc⁻/⁻Lig4⁻/⁻ mESCs, enabling a subset of pathogenic alleles to be repaired to wild-type with strikingly high precision. In wild-type mESCs, 183 pathogenic alleles are repaired to wild-type in ≥50% of all edited products and 11 pathogenic alleles are repaired to wild-type in ≥70% of all edited products, while in Prkdc⁻/⁻Lig4⁻/⁻ mESCs, 286 pathogenic alleles are repaired to wildtype in ≥50% of all edited products and 153 pathogenic alleles are repaired to wild-type in ≥70% of products (FIG. 15D, Table 6). Thus, impairing NHEJ can further increase the precise repair of pathogenic microduplications to wild-type (p=7.8*10⁻¹², FIG. 15D). These data support the model that competing end-joining repair mechanisms determine the relative frequencies of specific editing outcome types and demonstrate that template-free genotypic correction of hundreds of pathogenic microduplication alleles in genes such as PKD1 (corrected in 92% of edited Prkdc⁻/⁻Lig4⁻/⁻ mESC alleles), GJB2 (91%), MSH2 (88%), LDLR (87%), and BRCA1 (82%) can be optimized to occur with strikingly high efficiency by manipulation of repair pathways. inDelphi's prediction of highly efficient wild-type repair was further tested on pathogenic LDLR microduplication alleles, which cause dominantly inherited familial hypercholesterolemia[36]. Five pathogenic LDLR microduplication alleles were separately introduced within a full-length LDLR coding sequence upstream of a P2A-GFP cassette into the genome of human and mouse cells, such that Cas9-mediated repair to the wild-type LDLR sequence should induce phenotypic gain of LDL uptake and restore the reading frame of GFP. Cas9 and a gRNA that is specific to each pathogenic allele and does not target the wild-type repaired sequence were then deleivered. Robust restoration of LDL uptake was observed as well as restoration of GFP fluorescence in mESCs, U2OS cells, and HCT116 cells in up to 79% of cells following transfection with Cas9 and inDelphi gRNAs (FIGS. 15E, 15F, FIGS. 23A-23E). HTS confirms efficient genotypic repair to wild-type of these five LDLR microduplication alleles in human and mouse cells as well as of three other pathogenic microduplication alleles in the GAA, GLB1, and PORCN genes introduced to cells using the same method (Table 1, Table 3). Importantly, in these experiments, high-frequency LDLR phenotypic correction was observed when cutting with either SpCas9 or *Streptococcus aureus* Cas9 (SaCas9)[37] (Table 3), suggesting that microduplication repair is a feature of cellular repair after a Cas9-mediated double-strand break that does not require a specific nuclease.

Finally, precise template-free Cas9-mediated MMEJ was used to repair an endogenous pathogenic 16-bp microduplication in primary fibroblasts from a Hermansky-Pudlak syndrome (HPS1) patient. HPS1 causes blood clotting deficiency and albinism in patients and is particularly common in Puerto Ricans[38]. Simultaneous delivery of Cas9 and gRNA specific to the pathogenic microduplication allele induced high-efficiency correction to the wild-type sequence (mean frequency=71% of edited alleles, N=3, Table 1). These findings suggest the potential of template-free, precise Cas9 nuclease-mediated repair of microduplication alleles to achieve efficient repair to the wild-type sequence for therapeutic gain-of-function genome editing.

The following tables are referenced in this specification.

TABLE 1

Repair of microduplication pathogenic alleles through template-free Cas9-nuclease treatment.

| Pathogenic microduplication genotype | Cell type | Predicted frequency of repair to wild-type genotype in all major editing products (%) | Observed frequency of repair to wild-type genotype in all edited products in Lib-B, mESCs (%) | Observed frequency of repair to wild-type genotype in all edited outcomes in endogenous data (%) |
|---|---|---|---|---|
| HPS1:c.1472_1487 dup16 | Primary patient fibrobtasts | 88 | 53 | 71 |
| LDLR:c.1662_1689 dupGCTGGTGA | mESCs | 85 | 61 | 65 |
| LDLR:c.1662_1669 dupGCTGGTGA | HCT116 | 85 | 61 | 89 |
| LDLR:c.1662_1669 dupGCTGGTGA | USOS | 85 | 51 | 77 |

TABLE 2

Frequency of gRNAs in the human genome with denoted Cas9-mediated outcome precision.

| | Fraction of 1,003,524 SpCas9 gRNAs in human exons and introns for which the most-common repair genotype comprises >XX % of all major editing products | | |
|---|---|---|---|
| Precision gRNA frequency (%) | Precise product is a deletion (% of gRNAs) | Precise product is a 1-bp insertion (% of gRNAs) | Any precise product of gRNAs) |
| 10 | 86 | 35 | 96 |
| 15 | 63 | 23 | 78 |
| 30 | 43 | 14 | 55 |
| 35 | 29 | 10 | 39 |
| 30 | 20 | 6.2 | 26 |
| 35 | 13 | 4.1 | 17 |
| 40 | 8.6 | 2.6 | 11 |
| 45 | 5.8 | 1.3 | 7.1 |
| 50 | 3.8 | 0.94 | 4.8 |
| 55 | 2.4 | 0.52 | 3.0 |
| 60 | 1.5 | 0.39 | 1.9 |
| 65 | 0.98 | 0.086 | 1.1 |
| 70 | 0.58 | 0.026 | 0.61 |
| 75 | 0.29 | 0.024 | 0.32 |
| 80 | 0.12 | 0 | 0.12 |
| 85 | 0.040 | 0 | 0.040 |
| 90 | 0.0049 | 0 | 0.0049 |

TABLE 3

Repair of eight pathogenic microduplication alleles in individual cellular experiments.

| Pathogenic allele | LDLRdup1 | LDLRdup2 | LDLRdup2 | LDLRdup3 | LDLRdup4 | LDLRdup5 | PORCNdup | GAAdup | GAAdup | GLB1dup | HPS1dup | ATP7Adup |
|---|---|---|---|---|---|---|---|---|---|---|---|---|
| #AlleleID | 245617 | 245706 | 245706 | 245709 | 245715 | 246266 | 25739 | 354180 | 354180 | 98805 | ND | ND |
| Predicted frequency of deletions restoring frame | 79 | 98 | 96 | 95 | 86 | 94 | 90 | 76 | 93 | 95 | ND | ND |
| Flow cytometric frameshift frequency (%) | 57 | 95 | 57 | 90 | 72 | 87 | ND | 79 | 74 | 85 | ND | ND |
| Predicted frequency of repair to wild-type genotype among all major editing products (%) | 72 | 90 | 83 | 94 | 85 | 86 | 89 | 74 | 91 | 79 | 88 | 43 |
| Flow cytometric phenotypic repair frequency, mESC (%) | 36 | 69 | 30 | 53 | 33 | 78 | ND | ND | ND | ND | ND | ND |
| Observed frequency of repair to wild-type genotype among all edited products in HTS, mESC (%) | ND | 67 | 39 | 25 | 15 | 65 | 48 | 76 | 59 | 42 | ND | ND |
| Observed frequency of repair to wild-type genotype among all edited products in HTS, U2OS (%) | 100 | 88 | ND | ND | ND | 77 | ND | ND | ND | ND | ND | ND |
| Observed frequency of repair to wild-type genotype among all edited products in HTS, HCT116 (%) | ND | ND | ND | 24 | ND | 89 | ND | ND | ND | ND | ND | ND |

TABLE 3-continued

Repair of eight pathogenic microduplication alleles in individual cellular experiments.

| Pathogenic allele | LDLRdup1 | LDLRdup2 | LDLRdup3 | LDLRdup4 | LDLRdup5 | PORCNdup | GAAdup | GAAdup | GLB1dup | HPS1dup | ATP7Adup |
|---|---|---|---|---|---|---|---|---|---|---|---|
| Observed frequency of repair to wild-type genotype among all edited products in Lib-B, mESCs (%) | ND | ND | ND | ND | 58 | 42 | ND | 63 | 41 | ND | ND |
| Observed frequency of repair to wild-type genotype among all edited products in primary patient fibroblasts (%) | ND | ND | ND | ND | ND | ND | ND | ND | ND | 88 ± 14* | 98 |
| gRNA sequence (SEQ ID NOs: 11577-11588) from left to right | TGCGA AGATG GCTCG GAGGC | GCAAG GATAA ATTTG ACAGG | TCCTC GTCAG ATTTG TCCTG | CTGCA AGGAC AAATC TGAGG | TTTCC TCGTC AGATT TGTCG | ACATC TACTC GCTGG TGAGC | CTGTC CCTGG CTTTT ATCCC | AGCTG CAGAA GGTGA CTGCA | CTGCA GAAGG TGACT GCAGA | TGTGA ACTAT GGTGC ATATA | CAGCA GGGGA GGCCC CCAGC | TTTTT CCATA TAAGA TAAGA |
| Cas9 Type | KKH SaCas9 | KKH SaCas9 | KKH SaCas9 | KKH SaCas9 | SaCas9 | SaCas9 | KKH SaCas9 | SaCas9 | SaCas9 | SaCas9 | SaCas9 |

ND, not determined.
LDLRdup1, LDLR:c.526_533dupGGCTCGGA. LDLRdup2, LDLR:c.668_681dupAGGACAAATCTGAC. (SEQ ID NO: 1)
LDLRdup3, LDLR:c.669_680dupGGACAAATCTGA. LDLRdup4, LDLR:c672_683dupCAAATCTGACGA. LDLRdup5, LDLR:c.1662_1669dupGCTGGTGA. (SEQ ID NOs: 2 and 3)
PORCNdup, PORC:c.1059_1071dupCCTGGCTTTTATC. GAAdup, GAA:c.2704_2716dupCAGAAGGTGACTG. (SEQ ID NOs: 4 and 5)
GLB1dup, GLB1:c.1456_1466dupGGTGCATATAT (SEQ ID NO: 6)

Table 4: Lib-A sequences (presented below between the end of this specification and Table 5).

Table 5: Lib-B sequences (presented below between Table 4 and Table 6).

Table 6: inDelphi predictions and observed results. Table 6 comprises Table 6A: inDelphi predictions and observed results for Lib-B, showing all sequences with replicate-consistent mESC results; Table 6B (continued from 6A); Table 6C (continued from 6B); Table 6D (continued from 6C); and Table 6E (continued from 6D) (presented below between Table 5 and the claims).

TABLE 7

Frequency of gRNAs in the human genome with denoted Cas9-mediated outcome precision

| Precision-X threshold (%) | inDelphi trained on Lib-A data from mESCs for 1-bp ins. module | | | InDelphi trained on Lib-A data from U2OS cells for 1-bp ins. module | | |
|---|---|---|---|---|---|---|
| | Precise product is a deletion (% of gRNAs) | Precise product is a 1-bp insertion (% of gRNAs) | Total % of gRNAs that are precise-X | Precise product is a deletion (% of gRNAs) | Precise product is a 1-bp insertion (% of gRNAs) | Total % of gRNAs that are precise-X |
| 10 | 82 | 38 | 93 | 70 | 78 | 97 |
| 15 | 61 | 23 | 75 | 44 | 64 | 87 |
| 20 | 43 | 15 | 55 | 27 | 53 | 72 |
| 25 | 30 | 10 | 39 | 17 | 44 | 58 |
| 30 | 21 | 6.6 | 28 | 11 | 36 | 46 |
| 35 | 15 | 4.4 | 19 | 6.9 | 28 | 34 |
| 40 | 10 | 2.9 | 13 | 4.1 | 21 | 25 |
| 45 | 6.5 | 1.9 | 6.4 | 2.4 | 15 | 18 |
| 50 | 4.3 | 1.3 | 5.6 | 1.4 | 10 | 12 |
| 55 | 2.8 | 0.8 | 3.6 | 0.6 | 6.7 | 7.5 |
| 60 | 1.8 | 0.5 | 2.3 | 0.5 | 4.0 | 4.4 |
| 65 | 1.1 | 0.3 | 1.5 | 0.2 | 2.2 | 2.4 |
| 70 | 0.7 | 0.2 | 0.9 | 0.1 | 1.1 | 1.2 |
| 75 | 0.4 | 0.1 | 0.5 | 0.04 | 0.5 | 0.5 |
| 80 | 0.2 | 0.06 | 0.3 | 0.01 | 0.2 | 0.2 |
| 85 | 0.06 | 0.04 | 0.1 | 0.003 | 0.07 | 0.06 |
| 90 | 0.03 | 0.02 | 0.05 | 0.0007 | 0.03 | 0.03 |

TABLE 8

Endogenous repair of 24 designed high-precision gRNAs in human cell lines

| Gene, exon/chr, outsite (hg19) | Observed frequency among all edited products from deep sequencing at endogenous loci (%) | | | |
|---|---|---|---|---|
| | Frameshift, U2OS | Most frequent genotype, U2OS | Frameshift HEK293T | Most frequent genotype, HEK293T |
| VEGFA exon1: 456 | 91, 67 | 36, 34* | 90, 90 | 43, 40* |
| VEGFR2 exon5: 2 | 91, 91 | 50, 53* | 91, 91 | 50, 24* |
| PDCD1 exon5: 208 | 90, 90 | 20, 21* | 91, 90 | 29, 13* |
| APOB exon25: 147 | 83, 83 | 22, 21* | 87, 85 | 35, 18* |
| VEGFA exon3: 127 | 85, 89 | 27, 29* | 93, 91 | 55, 32* |
| CCR5 exon1: 1941 | 82, 81 | 20, 21* | 86, 84 | 43, 27* |
| CD274 exon2: 271 | 85, 86 | 9, 10* | 84, 82 | 31, 14* |
| APOB exon26: 5590 | 91, 89 | 26, 25* | 88 | 37* |
| VEGFR2 exon26: 19 | 82, 82 | 35, 33* | 82, 82 | 40, 24* |
| CXCR4 exon1: 825 | 86, 86 | 32, 33* | 91 | 54* |
| PCSK9 exon11: 15 | 81, 78 | 28, 25† | 78 | 27† |
| CCR5 exon1: 885 | 84, 85 | 55, 52† | 67 | 46† |
| CCR5 exon1: 1027 | 92, 94 | 61, 60† | 91, 92 | 49, 58† |
| APOB exon26: 5573 | 93, 93 | 75, 74† | 93, 95 | 69, 81† |
| CCR5 exon1: 61 | 94, 94 | 37, 25† | 83, 89 | 29, 38† |
| CCR5 exon1:1577 | 61, 61 | 28, 29† | 80, 83 | 29, 43† |
| APOB exon22: 100 | 89, 89 | 25, 27† | 91, 89 | 23, 38† |
| APOBEC3B exon3: 202 | 83, 84 | 50, 52† | 75, 88 | 51, 60† |
| MACCHC chr1: 45973892 | 97, 95 | 80, 77†‡ | 97, 98 | 78, 85†‡ |
| PROK2 chr3: 71821967 | 93, 94 | 44, 41†‡ | 93, 93 | 45, 53†‡ |
| IDS chrX: 148564700 | 95, 95 | 72, 74†‡ | 93, 95 | 64, 80†‡ |
| ECM1 chr1: 150484936 | 87, 89 | 44, 47†‡ | 89, 89 | 32, 35†‡ |

TABLE 8-continued

Endogenous repair of 24 designed high-precision gRNAs in human cell lines

| Gene, exon/chr, outsite (hg19) | Observed frequency among all edited products from deep sequencing at endogenous loci (%) | | | |
|---|---|---|---|---|
| | Frameshift, U2OS | Most frequent genotype, U2OS | Frameshift HEK293T | Most frequent genotype, HEK293T |
| KCNH2 chr7: 150644566 | 40 | 25†‡ | 65, 85 | 35, 14†‡ |
| LDLR chr19: 11222303 | 90, 91 | 76, 77†‡ | 90, 96 | 77, 83†‡ |

Discussion

The Cas9-mediated end-joining repair products of thousands of target DNA loci integrated into mammalian cells were used to train a machine learning model, inDelphi, that accurately predicts the spectrum of genotypic products resulting from double-strand break repair at a target DNA site of interest. The ability to predict Cas9-mediated products enables new precision genome editing research applications and facilitates existing applications.

The inDelphi model identifies target loci in which a substantial fraction of all repair products consists of a single genotype. The findings suggest that 26% of SpCas9 gRNAs targeting the human genome are precision gRNAs, yielding a single genotypic outcome in ≥30% of all major repair products, and 5% are high-precision gRNAs in which ≥50% of all major repair products are of a single genotype. Such precision and high-precision gRNAs enable uses of Cas9 nuclease in which the major genotypic products can be predicted a priori. Indeed, it was experimentally shown that high-precision, template-free Cas9-mediated editing can mediate efficient gain-of-function repair at hundreds of pathogenic alleles including microduplications (FIGS. 15B, 15E, 15F) in cell lines and in patient-derived primary cells (Table 1).

Moreover, evidence is presented that manipulation of available DNA repair pathways can further increase the precision of template-free repair outcomes. Suppressing NHEJ augments repair of pathogenic microduplication alleles, suggesting that temporary manipulation of DNA repair pathways could be combined with Cas9-mediated editing to favor specific editing genotypes with high precision. Genome editing currently lacks flexible strategies to correct indels in post-mitotic cells because of the limited efficiency of HDR in non-dividing cells[39]. As MMEJ is thought to occur throughout the cell cycle[40], inDelphi may provide access to predictable and precise post-mitotic genome editing in a wider range of cell states. It is also anticipated that, given appropriate training data, inDelphi will also be able to accurately predict repair genotypes from other double-strand break creation methods, including other Cas9 homologs, Cpf1, transcription activator-like effector nucleases (TALENs), and zinc-finger nucleases (ZFNs)[37,41-43] This work establishes that the prediction and judicious application of template-free Cas9 nuclease-mediated genome editing offers new capabilities for the study and potential treatment of genetic diseases.

Cellular Repair of Double-Stranded DNA Breaks and inDelphi

DNA double-strand breaks are detrimental to genomic stability, and as such the detection and faithful repair of genomic lesions is crucial to cellular integrity. A large number of genes have evolved to respond to and repair DNA double-strand breaks, and these genes can be broadly grouped into a set of DNA repair pathways[26], each of which differs in the biochemical steps it takes to repair DNA double-strand breaks. Accordingly, these pathways tend to produce characteristically distinguishable non-wildtype genotypic outcomes.

The goal of the machine learning algorithm, inDelphi, is to accurately predict the identities and relative frequencies of non-wildtype genotypic outcomes produced following a CRISPR/Cas9-mediated DNA double-strand break. To accomplish this goal, parameters were developed to classify three distinct categories of genotypic outcomes, microhomology deletions, microhomology-less deletions, and insertions, informed by the biochemical mechanisms underlying the DNA repair pathways that typically give rise to them.

Double strand breaks are thought to be repaired via four major pathways: classical non-homologous end-joining (c-NHEJ), alternative-NHEJ (alt-NHEJ), microhomology-mediated end-joining (MMEJ), and homology-directed repair (HDR)1. To create inDelphi, three machine learning modules were developed to model genotypic outcomes assuming characteristic of the c-NHEJ, microhomology mediated alt-NHEJ, and MMEJ pathways. While template-free CRISPR/Cas9 DNA double-strand break may lead to HDR repair via endogenous homology templates that exist in trans[45], HDR-characteristic outcomes are not explicitly modeled using the algorithm.

Before proceeding, it is important to note that while specific DNA repair pathways are characteristically associated with distinct genotypic outcomes, the proteins involved in the various pathways and the resulting repair products may at times overlap. This fact has several implications. First, conclusive statements cannot be made about the role of specific proteins or pathways in specific genotypic outcomes without perturbation experiments (e.g. the comparison of wildtype and Prkdc$^{-/-}$Lig4$^{-/-}$ mESCs can illuminate the roles of these proteins, specifically). Second, because assigning genotypic outcomes to biochemical mechanisms is likely imperfect, machine learning methods were used to identify trends and patterns in genotype frequencies that refine this crude binning process.

In the first step of the inDelphi method, genotypic outcomes were separated into three classes: microhomology deletions (MH deletions), microhomology-less deletions (MH-less deletions), and single-base insertions (1-bp insertions) (FIG. 12A). Below the algorithmic definitions of each genotypic outcome class are outlined, the pathways associated with each class, and the DNA sequence parameters included in inDelphi training of each class. For more detailed technical algorithmic definitions of the genotypic outcome classes.

MH Deletions are Predicted from MH Length, MH GC Content, and Deletion Length

The majority of Cas9-mediated double-strand break repair genotypes observed in the datasets are what are classified as MH deletions (53-58% in mESC, K562, HCT116, and HEK293). It is hypothesized that these deletions occur through MMEJ-like processes and use known features of this pathways to inform a machine learning module to predict MH deletion outcomes. Following 5'-end resection as occurs in MMEJ, alt-NHEJ, and HDR[26], microhomologous basepairing of single-stranded DNA (ssDNA) sequences occurs across the border of the double strand breakpoint[46, 47]. To restore a contiguous double-strand DNA chain, the 5'-overhangs not participating in the microhomology are removed up until the paired microhomology region, and the unpaired ssDNA sequences are extended by DNA polymerase using the opposing strand as a template (FIG. 12B, FIGS. 18A-18H).

Assuming these same processes, inDelphi calculates the set of all MH deletions available given a specific sequence context and cleavage site.

As an example workflow, given the following sequence and its cleavage site:

```
                        (SEQ ID NO: 7)
ACGTG|CATGA (SEQ ID NO: 11589)
TGCAC|GTACT
``` for every possible deletion length from 1-bp to 60-bp deletions, the 3'-overhang is overlapped downstream of the cut site under the upstream 3'-overhang and it is determined if there is any microhomologous basepairing. As an example, given the 4-bp deletion length:

```
ACGTG
 | ||
 GTACT
``` it is seen that there are three microhomologous basepairing events.

Then a particular microhomology is chosen (here, the italicized C:G):

```
A*C*GTG
 | ||
 *GTACT*
``` then generate its unique repair genotype by following left-to-right along the top strand and jumping down to the complement of the bottom strand to simulate DNA polymerase fill-in.
Here, this yields:

```
ACATGA

TGTACT
```

This can also be displayed as an alignment. It is noted that by "jumping down" after the first base in the top strand, this outcome can also be described using the delta-position 1. (See section on delta-positions). A deletion at delta-position 0 yields the same genotype.

```
Deletion b:    ACGTG----A

Wt:            ACGTGCATGA (SEQ ID NO: 7)
```

Thus, there may be multiple MH deletion outcome genotypes for a given deletion length, and there is always a 1:1 mapping between the microhomologous basepairing used in that MH deletion and the resultant genotypic outcome. The set of MH deletions thus includes all 1-bp to 60-bp deletions that can be derived from the steps above that simulate the MMEJ mechanism.

MMEJ efficiency has been reported to depend on the thermodynamic favorability and stability of a candidate microhomology[46, 47]. To parameterize MH deletions using the biochemical sequence features that influence this form of DNA repair, inDelphi calculates the MH length, MH GC content, and resulting deletion length for each possible MH deletion. These features are input into a machine learning module as the microhomology neural network (MH-NN) to learn the relationship between these features and the frequency of an MH deletion outcome in a training CRISPR/Cas9 genotypic outcome dataset. While it was predicted and empirically found that favored MH deletions have long MH lengths relative to total deletion length and high MH GC-contents, any explicit direction or comparative weighting to these parameters are not provided at the outset. inDelphi then outputs a phi-score for any MH deletion genotype (whether it was in the training data or not) that represents the favorability of that outcome as predicted by MH-NN.

It is important to emphasize that the phi-score of a particular MH deletion does not itself represent the likelihood of that MH deletion occurring in the context of all MH deletions at a given site. Some CRISPR/Cas9 target sites may have many possible favorable MH deletion outcomes while other sites have few, and thus phi-score must be normalized for a given target site to generate the fractional likelihood of that genotypic outcome at that site. Total unnormalized MH deletion phi-score is one factor that is further used to predict the relative frequency of the different repair classes: MH deletions, MH-less deletions, and insertions.

MH-Less Deletions are Predicted from their Length

MH-less deletions are defined as all possible deletions that have not been accounted for by the workflow described above for MH deletions. Mechanistically, the data analysis suggests that MH deletions are associated with repair genotypes produced by c-NHEJ and microhomology-mediated alt-NHEJ pathways.

Following a double-strand break, c-NHEJ-associated proteins rapidly bind the DNA strands flanking the double-strand DNA breakpoint and recruit ligases, exonucleases, and polymerases to process and re-anneal the breakpoint in the absence of 5'-end resection (FIGS. 18A-18H)[26, 35]. Commonly, c-NHEJ repair is error-free; however, in the context of Cas9-mediated cutting, faithful repair leads to repeated cutting, thereby increasing the eventual likelihood of mutagenic repair. Erroneous c-NHEJ repair products are mainly thought to consist of small insertions or deletions or combinations thereof that most frequently occur in the direct vicinity of the DNA break point[35, 48, 49]. The resulting deletions, which are referred to as medial end-joining MH-less deletions, have often lost bases both upstream and downstream of the cleavage site.

Microhomology-mediated alt-NHEJ is a distinct pathway that produces MH-less deletion products. In contrast to c-NHEJ, which is microhomology independent, this form of alt-NHEJ repair occurs following 5'-end resection and is mediated by microhomology in the sequence surrounding the double-strand break-point1. Microhomologous basepairing stabilizes the 3'-ssDNA overhangs following 5'-end resection, similarly to in MMEJ, allowing DNA ligases to join the break across one of the strands of this temporarily configured complex. The opposing un-annealed flap is then removed, and newly synthesized DNA templated off of the remaining strand is annealed to repair the lesion (FIGS. 18A-18H).

While alt-NHEJ uses microhomology, the repair products it produces do not follow the predictable genotypic patterns induced by MMEJ and are thus grouped into MH-less deletion genotypes. MH deletions are a direct merger of both annealed strands, in which the outcome genotype switches from top to bottom strand at the exact end-point of a microhomology. In contrast, while alt-NHEJ employs microhomology in its repair mechanism, the deletion outcomes it generates comprise bases exclusively derived from either the top or bottom strand. Mechanistically, this occurs because ligation of a 3'-overhang to its downstream ligation partner results in removal of the entire opposing ssDNA overhang up until the point of ligation. This process prevents any deletion from occurring in the 3'-overhang strand that is first attached to the DNA backbone, while inducing loss of an indeterminant length of sequence on the opposing strand. The resulting deletion genotypes, which are referred to as unilateral end-joining MH-less deletions, do not retain information on the exact microhomology causal to their occurrence, and are thus also referred to as MH-less.

Consequently, the various mechanisms that give rise to MH-less deletions are capable of generating a vast number of genotypic outcomes for any given deletion length. Having less information on the biochemical mechanisms that impact the relative frequency of NHEJ deletion products, inDelphi models these deletions without assuming any particular mechanism. inDelphi detects MH-less deletions from training data as the set of all deletions that are not MH deletions and parameterizes them solely by the length of the resulting deletion. This is based on the simple assumption that c-NHEJ and alt-NHEJ processes are most likely to produce short deletions, supported by the empirical observation. As with MH deletions, this assumption is not explicitly coded into the inDelphi MH-less deletion prediction module, instead allowing it to be "learned" by a neural network called MHless-NN.

MHless-NN optimizes a phi-score for a given MH-less deletion length, grounded in the frequency of MH-less deletion outcomes of that length observed in the training data. It was observed that MHless-NN learns a near-exponential decaying phi-score for increasing deletion length, that reflects the sum total frequency of all MH-less deletion genotypes. The total unnormalized MH-less deletion phi-score for a given target and cut site is also employed to inform the relative frequency of different repair classes.

1-Bp Insertions are Predicted from Sequence Context and Deletion Phi-Scores

Lastly, inDelphi predicts 1-bp insertions from both the broader sequence context and the immediate vicinity of the cleavage site. It was empirically found that 1-bp insertions are far more common than longer insertions, so the focus is on their prediction. It is classically assumed that short sequence insertions are the result of c-NHEJ[48,49], however, little else is known about their biochemical mechanism as it pertains to local sequence context to help inform prediction. Nonetheless, powerful correlations were found between the identities of the bases surrounding the Cas9 cleavage site and the frequency and identity of the inserted base (see main text). Motivated by these empirical observations, inDelphi is fed with training data on 1-bp insertion frequencies and identities at each training site parameterized with the identities of the −3, −4, and −5 bases upstream of the NGG PAM-sequence (when the training set is sufficiently large, and the −4 base alone when training data is limited) as features. Also added as features are the precision score of the deletion length distribution and the total deletion phi-score at that site. These features are combined into a k-nearest neighbor algorithm that predicts the relative frequencies and identities of 1-bp insertion products at any target site.

The Combination of the MH, MH-Less, and Insertion Model Predict Genotype Fractions Altogether, informed by known paradigms of DNA repair, 2 neural networks and a k-nearest neighbor model were built to predict genotypic outcomes following Cas9 cutting. These models compete and collaborate in inDelphi to generate predictions of the relative frequencies of these products. This competition within inDelphi among repair types reflects empirical evidence from Lib-A and Lib-B that sequence contexts do influence classes of repair outcomes. Sequence contexts with high phi scores (high microhomology) have higher efficiencies of MH deletions among all editing outcomes (FIG. 14B, FIGS. 20A-20E), and sequence contexts with low phi scores (low microhomology) have higher efficiencies of 1-bp insertions among all editing outcomes (FIGS. 14C, 14D, FIGS. 18A-18H,FIGS. 20A-20E). While it is tempting to generalize that the competition and collaboration among outcome classes modeled by inDelphi reflects interactions among components of distinct DNA repair pathways, the classes of outcomes considered by inDelphi do not necessarily arise from distinct DNA repair pathways as they are described above. inDelphi is trained on the repair outcomes only and cannot distinguish between the nature of genotypes when they may occur through MH-mediated and MH-less mechanisms, and it is imaginable that some repair products result through more than one repair pathway.

As an additional note, while NHEJ is generally assumed to dominate double-strand break repair from environmentally induced damage[35], it was found in the context of Cas9 cutting that MH deletion genotypes are more common than MH-less deletions and insertions. It is possible that error-free c-NHEJ is occurring frequently in response to Cas9 cutting but that its perfect repair allows for recurring Cas9 cutting that goes undetected by the workflow, thus skewing the observed relative frequency profile of mutagenic outcomes toward MMEJ-type repair.

Prkdc$^{-/-}$Lig4$^{-/-}$ Mutants have Distinct and Predictable DNA Repair Product Distributions While it is generally true that the work cannot establish roles for specific DNA repair pathways in specific types of Cas9-mediated outcomes, an experiment has been performed in which Cas9-mediated genotypic outcomes were measured from mESCs that are lacking Prkdc and Lig4, two proteins known to be key in c-NHEJ5. An increase in relative frequency of MH deletions was found as compared to MH-less deletions in Prkdc$^{-/-}$Lig4$^{-/-}$ mESCs as compared to wild-type mESCs (see main text), which is suggestive of an increase in MMEJ outcomes at the expense of NHEJ outcomes.

Intriguingly, it was also found that Prkdc$^{-/-}$Lig4$^{-/-}$ mESCs are impaired in unilateral deletions, where only bases from one side of the cutsite are removed, but not medial MH-less deletion outcomes that have loss of bases on both sides of the breakpoint. (FIGS. 22A-22E). As discussed earlier, microhomology-mediated alt-NHEJ, which it was hypothesized may give rise to unilateral MH-less deletions, proceeds through a mechanism in which DNA repair intermediates that mimic MMEJ-mediated repair are formed initially (FIGS. 18A-18H), as microhomology basepairing temporarily stabilizes 3'-overhangs following 5'-end resection. Subsequently, ligation joins one 3' overhang with the sequence on the other side of the DNA double-strand break, giving rise to a unilateral deletion. If the unilateral joining products observed in the experiments indeed arise through similar mechanisms as those described by this form of alt-NHEJ, it is conceivable that the MMEJ pathway may overtake 3'-end ligation at this microhomology-containing intermediate step when ligation is impaired through loss of Lig4. Thus, cross-talk of microhomology-mediated repair pathways could account for loss of unilateral end-joining MH-less outcomes and concomitant increase in MH deletion outcomes. Medial joining outcomes are not hypothesized to originate from intermediates that overlap with microhomology-mediated deletion products (FIGS. 18A-18H). Therefore, the repair genotypes generated via this orthogonal pathway may be afforded more time to be completed by ligases other than Lig4, thus explaining why these outcomes appear unaffected by NHEJ impairment.

While DNA repair products in $Prkdc^{-/-}Lig4^{-/-}$ mESCs differ substantially from those in wild-type cells, it was found that these DNA repair products are also highly predictable. In particular, inDelphi performed well on held-out $Prkdc^{-/-}Lig4^{-/-}$ data when trained on $Prkdc^{-/-}Lig4^{-/-}$ data (indel genotype prediction median Pearson correlation=0.84, indel length frequency prediction Pearson correlation=0.80), showing that the modeling approach is robustly capable of learning accurate predictions for Cas9 editing data in not just wild-type experimental settings but also settings with significant biochemical perturbation. As such, it is suggested here that inDelphi's modeling approach can be useful on additional tasks unexplored here provided that inDelphi is supplied with appropriate training data.

Methods

Library Cloning.

Specified pools of 2000 oligos were synthesized by Twist Bioscience and amplified with NEBNext polymerase (New England Biolabs) using primers OligoLib_Fw and OligoLib_Rv (see below), to extend the sequences with overhangs complementary to the donor template used for circular assembly. To avoid over-amplification in the library cloning process, qPCR was first performed by addition of SybrGreen Dye (Thermo Fisher) to determine the number of cycles required to complete the exponential phase of amplification. The PCR reaction was run for half of the determined number of cycles at this stage. Extension time for all PCR reactions was extended to 1 minute per cycle to prevent skewing towards GC-rich sequences. The 246-bp fragment was purified using a PCR purification kit (Qiagen).

Separately, the donor template for circular assembly was amplified with NEBNext polymerase (New England Biolabs) for 20 cycles from an SpCas9 sgRNA expression plasmid (Addgene 71485)[34] using primers CircDonor_Fw and CircDonor_Rv (see below) to amplify the sgRNA hairpin and terminator, and extended further with a linker region meant to separate the gRNA expression cassette from the target sequence in the final library. The 146-bp amplicon was gel-purified (Qiagen) from a 2.5% agarose gel.

The amplified synthetic library and donor templates were ligated by Gibson Assembly (New England Biolabs) in a 1:3 molar ratio for 1 hour at 50° C., and unligated fragments were digested with Plasmid Safe ATP-Dependent DNase (Lucigen) for 1 hour at 37° C. Assembled circularized sequences were purified using a PCR purification kit (Qiagen), linearized by digestion with SspI for ≥3 hours at 37° C., and the 237-bp product was gel purified (Qiagen) from a 2.5% agarose gel.

The linearized fragment was further amplified with NEBNext polymerase (New England Biolabs) using primers PlasmidIns_Fw and PlasmidIns_Rv (see below) for the addition of overhangs complementary to the 5'- and 3'-regions of a Tol2-transposon containing gRNA expression plasmid (Addgene 71485)[34] previously digested with BbsI and XbaI (New England Biolabs), to facilitate gRNA expression and integration of the library into the genome of mammalian cells. To avoid over-amplification, qPCR was performed by addition of SybrGreen Dye (Thermo Fisher) to determine the number of cycles required to complete the exponential phase of amplification, and then ran the PCR reaction for the determined number of cycles. The 375-bp amplicon was gel-purified (Qiagen) from a 2.5% agarose gel.

The 375-bp amplicon and double-digested Tol2-transposon containing gRNA expression plasmid were ligated by Gibson Assembly (New England Biolabs) in a 3:1 ratio for 1 hour at 50° C. Assembled plasmids were purified by isopropanol precipitation with GlycoBlue Coprecipitant (Thermo Fisher) and reconstituted in milliQ water and transformed into NEB10beta (New England Biolabs) electrocompetent cells. Following recovery, a small dilution series was plated to assess transformation efficiency and the remainder was grown in liquid culture in DRM medium overnight at 37° C. A detailed step-by-step library cloning protocol is provided below.

The plasmid library was isolated by Midiprep plasmid purification (Qiagen). Library integrity was verified by restriction digest with SapI (New England Biolabs) for 1 hour at 37° C., and sequence diversity was validated by high-throughput sequencing (HTS) as described below.

Library Cloning Primers

```
OligoLib_Fw
                                      (SEQ ID NO: 8)
TTTTTGTTTTCTGTGTTCCGTTGTCCGTGCTGTAACGAAAGGATGGGTGC

GACGCGTCAT

OligoLib_Rv
                                      (SEQ ID NO: 9)
GTTGATAACGGACTAGCCTTATTTAAACTTGCTATGCTGTTTCCAGCATA

GCTCTTAAAC

CircDonor_Fw
                                      (SEQ ID NO: 10)
GTTTAAGAGCTATGCTGGAAACAGC CircDonor_Rv
                                      (SEQ ID NO: 11)
ATGACGCGTCGCACCCATCCTTTCGTTACAGCACGGACAACGGAACACAG

AAAACAAAAAAGCACCGACTC

PlasmidIns_Fw
                                      (SEQ ID NO: 12)
GTAACTTGAAAGTATTTCGATTTCTTGGCTTTATATATCTTGTGGAAAGG

ACGAAACACC

PlasmidIns_Rv
                                      (SEQ ID NO: 13)
TTGTGGTTTGTCCAAACTCATCAATGTATCTTATCATGTCTGCTCGAAGC

GGCCGTACCTCTAGATTCAGACGTGTGCTCTTCCGATCT
```

Cloning.

A base plasmid was constructed starting from a Tol2-transposon containing plasmid (Addgene 71485)[34]. The sequence between Tol2 sites was replaced with a CAGGS promoter, multi-cloning site, P2A peptide sequence followed by eGFP sequence, and Puromycin resistance cassette to produce p2T-CAG-MCS-P2A-GFP-PuroR. The full sequence of this plasmid is appended in the Sequences section below, and this plasmid has been submitted to Addgene.

Plasmids with this backbone and containing wildtype and micro-duplication mutation versions of LDLR and three other genes, GAA, GLB1, and PORCN, were constructed. Information on cloning these genes is provided below, and the gene sequences are appended below.

LDLR: To generate p2T-CAGGS-LDLRwt-P2A-GFP-PuroR, LDLR (NCBI Gene ID #3949, transcript variant 1 CDS) was PCR amplified from a base plasmid ordered from the Harvard PlasmID resource core and cloned between the BamHI and NheI sites of the base plasmid.

The following mutants were generated through InFusion (Clontech) cloning. Sequences are provided below, and the internal allele nomenclature is in parentheses:

LDLR:c.526_533dupGGCTCGGA (LDLRdup252)

(SEQ ID NO: 14)
LDLR:c.668_681dupAGGACAAATCTGAC (LDLRdup254/255)

(SEQ ID NO: 15)
LDLR:c.669_680dupGGACAAATCTGA (LDLRdup258)

(SEQ ID NO: 16)
LDLR:c.672_683dupCAAATCTGACGA (LDLRdup261)

LDLR:c.1662_1669dupGCTGGTGA (LDLRdup264)

PORCN: NCBI Gene ID #64840, transcript variant C CDS was PCR amplified from HCT116 cDNA and cloned between the BamHI and NheI sites of the base plasmid. PORCN:c.1059_1071dupCCTGGCTTTTATC (SEQ ID NO: 17) (PORCNdup20) was generated through InFusion cloning.

GLB1: NCBI Gene ID #2720, transcript variant 1 CDS was PCR amplified from HCT116 cDNA and cloned between the BamHI and NheI sites of the base plasmid. GLB1:c.1456_1466dupGGTGCATATAT (SEQ ID NO: 18) (GLB1dup84) was generated through InFusion cloning.

GAA: NCBI Gene ID #2548, transcript variant 1 CDS was PCR amplified from a base plasmid ordered from the Harvard PlasmID resource core and cloned between the BamHI and NheI sites of the base plasmid. GAA: c.2704_2716dupCAGAAGGTGACTG (SEQ ID NO: 19) (GAAdup327/328) was generated through InFusion cloning.

SpCas9[1] and KKH SaCas9[9] were constructed starting from a Tol2-transposon containing plasmid (Addgene 71485)[34]. The sequence between Tol2 sites was replaced with a CAGGS promoter, Cas9 sequence, and blasticidin resistance cassette to produce p2T-CAG-SpCas9-BlastR and p2T-CAG-KKHSaCas9-BlastR. These plasmids have been submitted to Addgene.

SpCas9 guide RNAs were cloned as a pool into a Tol2-transposon containing gRNA expression plasmid (Addgene 71485)[34] using BbsI plasmid digest and Gibson Assembly (NEB). SaCas9 guide RNAs were cloned into a similar Tol2-transposon containing SaCas9 gRNA expression plasmid (p2T-U6-sgsaCas2xBbsI-HygR) which has been submitted to Addgene using BbsI plasmid digest and Gibson Assembly. Protospacer sequences used are listed below, using the internal nomenclature which matches the duplication alleles.

LDLR gRNAs
sgsaLDLRdup252:

(SEQ ID NO: 20)
GCTGCGAAGATGGCTCGGAGGC sgsaLDLRdup254:

(SEQ ID NO: 21)
GTGCAAGGACAAATCTGACAGG sgsaLDLRdup255:

(SEQ ID NO: 22)
GTTCCTCGTCAGATTTGTCCTG sgsaLDLRdup258:

(SEQ ID NO: 23)
GACTGCAAGGACAAATCTGAGG sgsaLDLRdup261:

(SEQ ID NO: 24)
GTTTTCCTCGTCAGATTTGTCG sgspLDLRdup264:

(SEQ ID NO: 25)
GACATCTACTCGCTGGTGAGC

PORCN gRNAs
sgspPORCNdup20:

(SEQ ID NO: 26)
GCTGTCCCTGGCTTTTATCCC

GLB1 gRNAs
sgspGLB1dup84:

(SEQ ID NO: 27)
GTGTGAACTATGGTGCATATA

GAA gRNAs
sgsaGAAdup327:

(SEQ ID NO: 28)
GCAGCTGCAGAAGGTGACTGCA sgspGAAdup328:

(SEQ ID NO: 29)
GCTGCAGAAGGTGACTGCAGA

Cell Culture.

Mouse embryonic stem cell lines used have been described previously and were cultured as described previously[44]. HEK293T, HCT116, and U2OS cells were purchased from ATCC and cultured as recommended by ATCC. For stable Tol2 transposon plasmid integration, cells were transfected using Lipofectamine 3000 (Thermo Fisher) using standard protocols with equimolar amounts of Tol2 transposase plasmid[25] (a gift from Koichi Kawakami) and transposon-containing plasmid. For library applications, 15-cm plates with >10$^7$ initial cells were used, and for single gRNA targeting, 6-well plates with >10$^6$ initial cells were used. To generate lines with stable Tol2-mediated genomic integration, selection with the appropriate selection agent at an empirically defined concentration (blasticidin, hygromycin, or puromycin) was performed starting 24 hours after transection and continuing for >1 week. In cases where sequential plasmid integration was performed such as integrating gRNA/target library and then Cas9 or micro-duplication plasmid and then Cas9 plus gRNA, the same Lipofectamine 3000 transfection protocol with Tol2 transposase plasmid was performed each time, and >1 week of appropriate drug selection was performed after each transfection.

Deep Sequencing.

Genomic DNA was collected from cells after >1 week of selection. For library samples, 16 μg gDNA was used for each sample; for individual locus samples, 2 μg gDNA was used; for plasmid library verification, 0.5 μg purified plasmid DNA was used.

For individual locus samples, the locus surrounding CRISPR/Cas9 mutation was PCR amplified in two steps using primers >50-bp from the Cas9 target site. PCR1 was performed using the primers specified below. PCR2 was performed to add full-length Illumina sequencing adapters using the NEBNext Index Primer Sets 1 and 2 (NEB) or internally ordered primers with equivalent sequences. All PCRs were performed using NEBNext polymerase (New England Bioscience). Extension time for all PCR reactions was extended to 1 min per cycle to prevent skewing towards GC-rich sequences. The pooled samples were sequenced using NextSeq (Illumina) at the Harvard Medical School Biopolymers Facility, the MIT BioMicro Center, or the Broad Institute Sequencing Facility.

Library Prep Primers:

```
For LDLRDup252, 254, 255, 258, 261:
120417_LDLRDup254_r1_seq_A
                                    (SEQ ID NO: 30)
CTTTCCCTACACGACGCTCTTCCGATCT NNN

ACTCCAGCTGGCGCTGTGAT

120417_LDLR254_r2seq_A
                                    (SEQ ID NO: 31)
GGAGTTCAGACGTGTGCTCTTCCGATCT

CAACTTCATCGCTCATGTCCTTG

For LDLRDup264:
120817_LDLR264_r1seq_B
                                    (SEQ ID NO: 32)
CTTTCCCTACACGACGCTCTTCCGATCT

NNNAACTCCCGCCAAGATCAAGAAAG

120817_LDLR264_r2seq_B
                                    (SEQ ID NO: 33)
GGAGTTCAGACGTGTGCTCTTCCGATCT

CAGCCTCTTTTCATCCTCCAAGA

For PORCDup20:
120517_PORCN20_r1_seq
                                    (SEQ ID NO: 34)
CTTTCCCTACACGACGCTCTTCCGATCT NNN

CCTCCTACATGGCTTCAGTTTCC

120517_PORCN20_r2seq
                                    (SEQ ID NO: 35)
GGAGTTCAGACGTGTGCTCTTCCGATCT

CCAGAGCTCCAAAGAGCAAGTTT

For GLB1Dup84:
120517_GLB_184_r1seq
                                    (SEQ ID NO: 36)
CTTTCCCTACACGACGCTCTTCCGATCT NNN

AGCCACTCTGGACCTTCTGGTA

120517_GLB_184_r2seq
                                    (SEQ ID NO: 37)
GGAGTTCAGACGTGTGCTCTTCCGATCT

CCAGTCCGTGAGGATATTGGAAC

For GAADup327/328:
120517_GAA327_r1seq
                                    (SEQ ID NO: 38)
CTTTCCCTACACGACGCTCTTCCGATCT NNN

GATCGTGAATGAGCTGGTACGTG

120517_GAA327_r2seq
                                    (SEQ ID NO: 39)
GGAGTTCAGACGTGTGCTCTTCCGATCT

AACAGCGAGACACAGATGTCCAG
```

Data Availability.

High-throughput sequencing data have been deposited in the NCBI Sequence Read Archive database under accession codes SRP141261 and SRP141144.

Code Availability.

All data processing, analysis, and modeling code is available at github.com/maxwshen/inDelphi-dataprocessinganalysis. The inDelphi model is available online at the URL crisprindelphi.design.

Library Cloning Protocol

Synthesized Oligo Library Sequence

```
                                            (SEQ ID NO: 40)
GATGGGTGCGACGCGTCAT[55bpTarget]AGATCGGAAGAGCACA CGTCTGAATATTGTGGA AAGGACGAAACACCG[19/20-nt PROTOSPACER depending on whether it naturally starts with a G] GTTTAAGAGCTATGCTGGAAACAGC
```

Linker Region/Oligo Library Amplification Primer Anneal Region

Read 2 Sequencing Primer Stub

SspI Restriction Site

U6-Promoter Stub sgRNA-Hairpin Stub

1. Oligo library QPCR to determine number of amplification cycles for Oligo Library PCR Notes: Amplification of oligos with relatively low GC-content is less efficient than GC-rich sequences. It was found that NEBNext polymerase was the least biased in amplification of the library. Increasing the elongation time to 1 min per cycle for all cloning and sequencing library prep PCRs eliminates GC-skewing of library sequences and reduces the rate of PCR-recombination.

Set up the following reaction:

| | |
|---|---|
| 0.4 ng | Synthesized Oligo Library |
| 10 ul | NEBNext 2x Master Mix |
| 0.5 ul | 20 uM OligoLib_Fw |
| 0.5 ul | 20 uM OligoLib_Rv |
| 0.2 ul | SybrGreen Dye (100x) |
| to 20 ul | H$_2$O |

67° C. annealing temperature

Check 246 bp amplicon size on 2.5% agarose gel.

Determine the point that signal amplification has plateaued.

2. Oligo Library PCR Amplification

Set up the following reaction:

| | |
|---|---|
| 4 ng | Synthesized Oligo Library |
| 50 ul | NEBNext 2x Master Mix |
| 2.5 ul | 20 uM OligoLib_Fw |
| 2.5 ul | 20 uM OligoLib_Rv |
| to 100 ul | H$_2$O |

67° C. annealing temperature, 1 minute extension time.

Cycle number is half the number of cycles needed to reach signal amplification plateau in the QPCR in step 1, reduced by 1 cycle to scale for DNA input.

PCR purify amplified sequence. 3. Donor template amplification

Set up the following reaction:

| 5 ng | spCas9 sgRNA plasmid (71485) |
|---|---|
| 50 ul | NEBNext 2x Master Mix |
| 2.5 ul | 20 uM CircDonor_Fw |
| 2.5 ul | 20 uM CircDonor_Rv |
| to 100 ul | H$_2$O |

62° C. annealing temperature
20 cycles
Gel purify 167 bp band from 2.5% agarose gel.

4. Circular assembly and restriction digest linearization

Note: A molar ratio of donor template to amplified oligo library of 3:1 was used. An increase in amplified oligo library compounds cross-over within library members resulting in mismatch of protospacer and target sequences.

Set up the following reaction:

| 429 ng | Donor template |
|---|---|
| 239 ul | Amplified Oligo Library |
| 30 ul | Gibson Assembly 2x Master Mix |
| to 60 ul | H$_2$O |

50° C. incubation for 1 hour.
Exonuclease treatment

| 60 ul | Circular assembly reaction |
|---|---|
| 9 ul | ATP (25 mM) |
| 9 ul | 10x Plasmid Safe Buffer |
| 3 ul | Plasmid Safe Nuclease |
| 9 ul | H$_2$O |

37° C. incubation for 1 hour.
PCR purify and elute in 50 ul.
Digest to linearize library

| 50 ul | Purified assemblies |
|---|---|
| 10 ul | 10x CutSmart Buffer |
| 3 ul | SspI-HF |
| 37 ul | H$_2$O |

37° C. incubation for ≥3 hours.
Gel purify 273 bp band from 2.5% agarose gel.
Note: Band is sometimes fuzzy and poorly visible. If not clearly discernible, proceed with gel isolation between 200-300 bp.

5. Linearized Library QPCR to Determine Number of Amplification Cycles for PCR Amplification Set up the following reaction:

| 0.5% | Purified linearized library |
|---|---|
| 10 ul | NEBNext 2x Master Mix |
| 0.5 ul | 20 uM PlasmidIns_Fw |
| 0.5 ul | 20 uM PlasmidIns_Rv |
| 0.2 ul | SybrGreen Dye (100x) |
| to 20 ul | H$_2$O |

65° C. annealing temperature
Determine the point that signal amplification has plateaued.

6. Linearized Library PCR amplification

Set up the following reaction:

| 50% | Purified linearized library |
|---|---|
| 50 ul | NEBNext 2x Master Mix |
| 2.5 ul | 20 uM PlasmidIns_Fw |
| 2.5 ul | 20 uM PlasmidIns_Rv |
| to 100 ul | H$_2$O |

65° C. annealing temperature, 1 minute extension time.
Cycle number is number of cycles needed to reach signal amplification plateau in the QPCR in step 5, reduced by 4 cycles to scale for increased DNA input.
Gel purify 375 bp band from 2.5% agarose gel.

7. Vector backbone digest

Set up the following reaction:

| 2 ug | spCas9 sgRNA plasmid (71485) |
|---|---|
| 10 | 10x Buffer 2.1 |
| 3 | BbsI |
| 2 | XbaI |
| to 100 ul | H$_2$O |

37° C. incubation for ≥3 hours.
Gel purify 5.9 kb band from 1% agarose gel.

8. Vector assembly and cleanup

Note: Include a ligation with water for insert as a control.
Set up the following reaction:

| 300 ng | Digested vector backbone |
|---|---|
| 42 ng | Amplified Oligo Library |
| 30 ul | Gibson Assembly 2x Master Mix |
| to 60 ul | H$_2$O |

50° C. incubation for 1 hour.
Isopropanol precipitation

| 40 ul | Vector assembly reaction |
|---|---|
| 0.4 ul | GlycoBlue Coprecipitant |
| 0.8 ul | 50 mM NaCl |
| 38.8 ul | Isopropanol |

Vortex and incubate at room temperature for 15 minutes.
Spin down at ≥15.000 g for 15 minutes, and carefully remove supernatant.
Wash pellet with 300 ul 80% EtOH and repeat spin at ≥15.000 g for 5 minutes.
Carefully remove all liquid without disturbing pellet, and let air dry for 1-3 minutes.—Dissolve dried pellet in 10 ul H2O at 55° C. for 10 minutes.

9. Transformation

Note: Electroporation competent cells give a higher transformation efficiency than chemically competent cells. NEB10beta electro-competent cells were used, however these can be substituted for other lines and transformed according to the manufacturer's instructions.

Note: DRM was used as recovery and culture medium to enhance yield. If substituting for a less rich medium such as LB, it is recommended scaling up the culture volume to obtain similar plasmid DNA quantities.

Note: Antibiotic-free recovery time should be limited to 15 minutes to prevent shedding of transformed plasmids from replicating bacteria.

Note: Also transform water ligation as control.
  Pre-warm 3.5 mL recovery medium per electroporation reaction, at 37° C. for 1 hour.
  Pre-warm LB-agar plates containing appropriate antibiotic.
  Per reaction, add 1 ul purified vector assembly to 25 ul competent cells on ice.
  Perform 8 replicate reactions.
  Electroporate according to the manufacturer's instructions.
  Immediately add 100 ul pre-warmed recovery media per cuvette and pool all replicates into culture flask.
  Add 1 mL recovery media per replicate reaction to culture flask and shake at 200 rpm 37° C. for 10-15 minutes.
  Plate a dilution series from 1:104-1:106 on LB-agar plates containing antibiotic and grow overnight at 37° C.
  Add 2 mL media per replicate reaction and admix appropriate antibiotic.
  Grow overnight in shaking incubator at 200 rpm 37° C.
  Assess transformation efficiency from serial dilution LB-agar plates. Expect ~$10^6$ clones.

The development of this cloning protocol was guided by work described in Videgal et al. 2015.

Sequence Alignment and Data Processing

For library data, each sequenced pair of gRNA fragment and target was associated with a set of designed sequence contexts G by finding the designed sequence contexts for all gRNAs whose beginning section perfectly matches the gRNA fragment (read 1 in general does not fully sequence the gRNA), and by using locality sensitive hashing (LSH) with 7-mers on the sequenced target to search for similar designed targets. An LSH score on 7-mers between a reference and a sequenced context reflects the number of shared 7-mers between the two. If the best reference candidate scored, through LSH, greater than 5 higher than the best LSH score of the reference candidates obtained from the gRNA-fragment, the LSH candidate is also added to G. LSH was used due to extensive (~33% rate) PCR recombination between read1 and read2 which in sequenced data appears as mismatched read1 and read2 pairs. The sequenced target was aligned to each candidate in G and the alignment with the highest number of matches is kept. Sequence alignment was performed using the Needleman-Wunsch algorithm using the parameters: +1 match, −1 mismatch, −5 gap open, −0 gap extend. For library data, starting gaps cost 0. For all other data, starting and ending gaps cost 0. For VO data, sequence alignments were derived from SAM files from SRA.

Alignments with low-accuracy or short matching sections flanked by long (10 bp+) insertions and deletions were filtered out as PCR recombination products (observed frequency of ~5%). These PCR recombination products are different than that occurring between read1 and read2; these occur strictly in read2. Alignments with low matching rates were removed. Deletions and insertions were shifted towards the expected cleavage site while preserving total alignment score. CRISPR-associated DNA repair events were defined as any alignment with deletions or insertions occurring within a 4 bp window centered at the expected cut site and any alignment with both deletions and insertions (combination indel) occurring with a 10 bp window centered at the expected cut site. All CRISPR-associated DNA repair events observed in control data had their frequencies subtracted from treatment data to a minimum of 0.

Replicate experiments were carried out for library data in each cell type. For each cell-type, each sequence context not fulfilling the following data quality criteria was filtered: data at this sequence context in the two replicates with the highest read-counts must have at least 1000 reads of CRISPR editing outcomes in both replicates, and a Pearson correlation of at least 0.85 in the frequency of microhomology-based deletion events. The class of microhomology-based deletion events was used for this criterion since it is a major repair class with the highest average replicability across experiments. For disease library data in U2OS and HEK, a less stringent read count threshold of 500 was used instead.

Details on Alignment Processing

All alignments with gaps were shifted as much as possible towards the cleavage site while preserving the overall alignment score. Then, the following criteria were used to categorize the alignments into noise, not-noise but not CRISPR-associated (for example, wildtype); as well as primary and secondary CRISPR activity. All data used in modeling and analysis derive solely from outcomes binned into primary CRISPR activity.

The following criteria was used to filter library alignments into "noise" categories. Homopolymer: Entire read is homopolymer of a single nucleotide. Not considered a CRISPR repair product.

Has N: Read contains at least one N. Discarded as noise, not considered a CRISPR repair product.

PCR Recombination: Contains recombination alignment signature: (1) if a long indel (10 bp+) followed by chance overlap followed by long indel (10 bp+) of the opposite type, e.g., insertion-randommatch-deletion and deletion-randommatch-insertion. OR, if one of these two indels is 30 bp+, the other can be arbitrarily short. If either criteria is true, and if the chance overlap is length 5 or less, or any length with less than 80% match rate, then it satisfies the recombination signature. In addition, if both indels are 30 bp+, regardless of the middle match region, it satisfies the recombination signature. Finally, if randommatch is length 0, then indel is allowed to be any length. Not considered a CRISPR repair product.

Poor-Matches: 55 bp designed sequence context has less than 5 bp representation (could occur from 50 bp+ deletions or severe recombination) or less than 80% match rate. Not considered a CRISPR repair product.

Cutsite-Not-Sequenced: The read does not contain the expected cleavage site.

Other: An alignment with multiple indels where at least one non-gap region has lower than an 80% match rate. Or generally, any alignment not matching any defined category above or below. In practice, can include near-homopolymers. Not considered a CRISPR repair product.

The following criteria was used to filter library alignments into "main" categories.

Wildtype: No indels in all of alignment. Not considered a CRISPR repair product.

Deletion: An alignment with only a single deletion event. Subdivided into: Deletion—Not CRISPR: Single deletion occurs outside of 2 bp window around cleavage site. Not considered a CRISPR repair product.

Deletion—Not at cut: Single deletion occurring within 2 bp window around cleavage site, but not immediately at cleavage site. Considered a CRISPR repair product.

Deletion: Single deletion occurring immediately at cleavage site. Considered a CRISPR repair product.

Insertion: An alignment with only a single insertion event. Subdivided into:

Insertion—Not CRISPR: Single insertion occurs outside of 10 bp window around cleavage site. Not considered a CRISPR repair product.

Insertion—Not at cut: Single insertion occurring within 2 bp window around cleavage site, but not immediately at cleavage site. Considered a CRISPR repair product.

Insertion: Single insertion occurring immediately at cleavage site. Considered a CRISPR repair product.

Combination indel: An alignment with multiple indels where all non-gap regions have at least 80% match rate. Subdivided into:

Combination Indel: All indels are within a 10 bp window around the cleavage site. Considered a primary CRISPR repair product.

Forgiven Combination Indel: At least two indels, but not all, are within a 10 bp window around the cleavage site. Considered a rarer secondary CRISPR repair product, ignored.

Forgiven Single Indel: Exactly one indel is within a 10 bp window around the cleavage site. Considered a rarer secondary CRISPR repair product, ignored.

Combination Indel—Not CRISPR: No indels are within a 10 bp window around the cleavage site. Not considered a CRISPR repair product.

It is noted that deletion and insertion events, even those spanning many bases, are defined to occur at a single location between bases. As such, events occurring up to 5 bp away from the cleavage site are defined as events where there are five or fewer matched/mismatched alignment positions between the event and the cleavage site, irrespective of the number of gap dashes in the alignment.

Selection of Variants from Disease Databases

Disease variants were selected from the NCBI ClinVar database (downloaded Sep. 9, 2017)[16] and the Human Gene Mutation Database (publicly available variant data from before 2014.3)[17] for computational screening and subsequent experimental correction.

A total of 4,935 unique variants were selected from Clinvar submissions where the functional consequence is described as complete insertions, deletions, or duplications where the reference or alternate allele is of length less than or equal to 30 nucleotides. Variants were included where at least one submitting lab designated the clinical significance as 'pathogenic' or 'likely pathogenic' and no submitting lab had designated the variant as 'benign' or 'likely benign', including variants will all disease associations. More complex indels and somatic variants were included. A total of 18,083 unique insertion variants were selected from HGMD which were between 2 to 30 nucleotides in length. Variants were included with any disease association with the HGMD classification of 'DM' or disease-causing mutation.

SpCas9 gRNAs and their cleavage sites were enumerated for each disease allele. Using a previous version of inDelphi, genotype frequency and indel length distributions were predicted for each tuple of disease variant and unique cleavage site. Among each unique disease, the single best gRNA was identified as the gRNA inducing the highest predicted frequency of repair to wildtype genotype, and if this was impossible (due to, for example, a disease allele with 2+ bp deletion), then the single best gRNA was identified as the gRNA inducing the highest predicted frameshift repair rate. 1327 sequence contexts were designed in this manner for Lib-B. An additional 265 sequence contexts were designed by taking the 265 sequence contexts in any disease in decreasing order of predicted wildtype repair rate, starting with Clinvar, stopping at 45% wildtype repair rate, then continuing with HGMD. This yielded 1592 total sequences derived from Clinvar and HGMD.

Definition of Delta-Positions

Using the MMEJ mechanism, deletion events can be predicted at single-base resolution. For computational convenience, the tuple (deletion length, delta-position) was used to construct a unique identifier for deletion genotypes. A delta-position associated with a deletion length N is an integer between 0 and N inclusive (FIGS. 19A-19D). In a sequence alignment, a delta-position describes the starting position of the deletion gap in the read w.r.t. the reference sequence relative to the cleavage site. For a deletion length N and a cleavage site at position C such that seq[:C] and seq[C:] yield the expected DSB products where the vector slicing operation vector[index1:index2] is inclusive on the first index and exclusive on the second index (python style), a delta-position of 0 corresponds to a deletion gap at seq[C−N+0: C+0], and generally with a delta-position of D, the deletion gap occurs at seq[C−N+D: C+D]. Microhomologies can be described with multiple delta-positions. To uniquely identify microhomology-based deletion genotypes, the single maximum delta-position in the redundant set is used. Microhomology-less deletion genotypes are associated with only a single delta position and deletion length tuple; this was used as its unique identifier.

Another way to define delta-positions can be motivated by the example workflow shown above on MH deletions describing how each microhomology is associated with a deletion genotype. In that workflow, the delta-position is the number of bases included on the top strand before "jumping down" to the bottom strand.

MH-less medial end-joining products correspond to all MH-less genotypes with delta-position between 1 and N−1 where N is the deletion length. MH-less unilateral end-joining products correspond to MH-less genotypes with delta-position 0 or N. It is noted that a deletion genotype with delta position N does not immediately imply that it is a microhomology-less unilateral end-joining product since it may contain microhomology (it's possible that delta-positions N−j, N−j+1, . . . , N all correspond to the same MH deletion.)

Definition of Precision Score

For a distribution X, where |X| indicates its cardinality (or length when represented as a vector):

$$PrecisionScore(X) = 1 - \frac{-\sum_{i=1}^{n} P(x_i) \log(P(x_i))}{\log(|X|)}$$

This precision score ranges between zero (minimally precise, or highest entropy) to one (maximally precise, or lowest entropy).

inDelphi Deletion Modeling: Neural Network Input and Output inDelphi receives as input a sequence context and a cleavage site location, and outputs two objects: a frequency distribution on deletion genotypes, and a frequency distribution on deletion lengths.

To model deletions, inDelphi trains two neural networks: MH-NN and MHless-NN.

MH-NN receives as input a microhomology that is described by two features: microhomology length and GC fraction in the microhomology. Using these features, MH-NN outputs a number (psi). MHless-NN receives as input the deletion length. Using this feature, MHless-NN outputs a number (psi).

A phi score is obtained from a psi score using: phi_i=exp (psi_i−0.25*deletion_length), where 0.25 is a "redundant"

hyperparameter that serves to reduce training speed by helpful scaling. This relationship between psi and phi is differentiable and encodes the assumption that the frequency of an event exponentially increases with neural network output psi (which empirically appears to reflect MH strength) and exponentially decreases with its minimum necessary resection length (deletion length).

The architecture of the MH-NN and MHless-NN networks are input-dimension →16 →16 →1 for a total of two hidden layers where all nodes are fully connected. Sigmoidal activations are used in all layers except the output layer. All neural network parameters are initialized with Gaussian noise centered around 0.

inDelphi Deletion Modeling: Making Predictions

Given a sequence context and cleavage site, inDelphi enumerates all unique deletion genotypes as a tuple of its deletion length and its delta-position for deletion lengths from 1 bp to 60 bp. For each microhomology enumerated, an MH-phi score is obtained using MH-NN. In addition, for each deletion length from 1 bp to 60 bp, an MHindep-phi score is obtained using MHless-NN.

inDelphi combines all MH-phi and MHindep-phi scores for a particular sequence context into two objects—a frequency distribution on deletion genotypes, and a frequency distribution on deletion lengths—which are both compared to observations for training. The model is designed to output two separate objects because both are of biological interest, and separate but intertwined modeling approaches are useful for generating both. By learning to generate both objects, inDelphi jointly learns about microhomology-based deletion repair and microhomology-less deletion repair.

To generate a frequency distribution on deletion genotypes, inDelphi assigns a score for each microhomology. Score assignment considers the concept of "full" microhomology and treats full and not full MHs differently.

A microhomology is "full" if the length of the microhomology is equal to its deletion length. The biological significance of full microhomologies is that there is only a single deletion genotype possible for the entire deletion length, while in general, a single deletion length is consistent with multiple genotypes. In addition, this single genotype can be generated through not just the MH-dependent MMEJ mechanism but also through MH-less end-joining, for example as mediated by Lig4. Therefore, full microhomologies were modelled as receiving contributions from both MH-containing and MH-less mechanisms by scoring full microhomologies as MH-phi[i]+MHindep-phi[j] for deletion length j and microhomology index i. Microhomologies that are not "full" are assigned a score of MH-phi[i] for MH index i.

Scores for all deletion genotypes assigned this way are normalized to sum to 1 to produce a predicted frequency distribution on deletion genotypes.

To generate a frequency distribution on deletion lengths, inDelphi assigns a score for each deletion length. Score assignment integrates contributions from both MH-dependent and MH-independent mechanisms via the following procedure: For each deletion length j, its score is assigned as MHindep-phi[j] plus the sum of MH-phi for each microhomology with that deletion length. Scores for all deletion lengths are normalized to sum to 1 to produce a frequency distribution.

inDelphi trains its parameters using a single sequence context by producing both a predicted frequency distribution on deletion genotypes and deletion lengths and minimizing the negative of the sum of squared Pearson correlations for both objects to their observed versions. In practice, deletion genotype frequency distributions are formed from observations for deletion lengths 1-60, and deletion length frequency distributions are formed from observations for deletion lengths 1-28. Both neural networks are trained simultaneously on both tasks. inDelphi is trained with stochastic gradient descent with batched training sets. inDelphi is implemented in Python using the autograd library. A batch size of 200, an initial weight scaling factor of 0.10, an initial step size of 0.10, and an exponential decaying factor for the step size of 0.999 per step were used.

inDelphi Deletion Modeling: Summary and Revisiting Assumptions

In summary, inDelphi trains MH-NN, which uses as input (microhomology length, microhomology GC content) to output a psi score which is translated into a phi score using deletion length. This phi score represents the "strength" of the microhomology corresponding to a particular MH deletion genotype. It also trains MHless-NN which uses as input (deletion length) to directly output a phi score representing the "total strength" of all MH-independent activity for a particular deletion length.

While the model assumes that microhomology and microhomology-less repair can overlap in contributions to a single repair genotype, this assumption is made conservatively by assuming that their contributions overlap only when there is no alternative. Specifically, in the context of a deletion length with full microhomology, the model assumes that they must overlap, while in the context of a deletion length without full microhomology, inDelphi allows MHindep-phi to represent all MH-less repair genotypes and none of the MH-dependent repair genotypes which are represented solely using their MH-phi scores. This can be seen by noting that at a deletion length j without full microhomology, MH genotypes are scored using their MH-phi scores, while the length j is scored by MHindep-phi[j] plus the sum of MH-phi for each microhomology. Therefore, the subset of MH-less genotypes at this deletion length have a score MHindep-phi[j].

When the subset of MH-less genotypes includes only one MH-less genotype, this single genotype's score is equal to MHindep-phi[j]. In general, multiple MH-less genotypes are possible, in which case the total score of all of the MH-less genotypes is equal to MHindep-phi[j].

The relative frequency of MH deletions and MH-less deletions is learned implicitly by the balancing between the sum of all MH-phi and MHindep-phi. Since MHindep-phi does not vary by sequence context while MH-phi does, the model assumes that variation in the fraction of deletions that use MH can at least partially be explained by varying sequence microhomology as represented by MH-NN.

inDelphi Insertion Modeling

Once inDelphi is trained on both deletion tasks, it predicts insertions from a sequence context and cleavage site by using the precision score of the predicted deletion length distribution and total deletion phi (from all MH-phi and MHindep-phi). inDelphi also uses one-hot-encoded binary vectors encoding nucleotides −4 and −3. In a training set, these features are collected and normalized to zero mean and unit variance, and the fraction of 1-bp insertions over the sum counts of 1-bp insertions and all deletions are tabulated as the prediction goal. A k-nearest neighbor model is built using the training data. inDelphi uses the default parameter k=5.

On test data, the above procedure is used to predict the frequency of 1-bp insertions out of 1-bp insertions and all deletions for a particular sequence context. Once this frequency is predicted, it is used to make frequency predictions for each of the 4 possible insertion genotypes, which are predicted by deriving from the training set the average insertion frequency for each base given its local sequence context. When the training set is small, only the −4 nucleotide is used. When the training set is relatively large, nucleotides −5, −4, and −3 are used.

To produce a frequency distribution on 1-bp insertions and 1-60 bp deletion genotypes, scores for all deletion genotypes and all 1-bp insertions are normalized to sum to 1. To produce a frequency distribution on indel lengths (+1 to −60), scores for all deletion lengths and 1-bp insertions are normalized to sum to 1.

inDelphi: Repair Classes Predicted at Varying Resolution inDelphi predicts MH-deletions and 1-bp insertions at single base resolution. Measuring performance on the task of genotype frequency prediction considers this subset of repair outcomes only (about 60-70% of all outcomes). inDelphi predicts MH-less deletions to the resolution of deletion length. That is, inDelphi predicts a single frequency corresponding to the sum total frequency of all unique MH-less deletion genotypes possible for a particular deletion length. This modeling choice was made because genotype frequency replicability among MH-less deletions is substantially lower than among MH deletions.

Measuring performance on the task of indel length frequency considers MH deletions, MH-less deletions, and 1-bp insertions (90% of all outcomes).

In practice, if end-users desire, they can extend inDelphi predictions to frequency predictions for specific MH-less deletion genotypes by noting that MH-less deletions are distributed uniformly between 0 delta-position genotypes, medial genotypes, and N delta-position genotypes.

Comparison with a Linear Baseline Model inDelphi was compared to a baseline model with the same model structure but replacing the deep neural networks with linear models. The comparison was done using Lib-A mESC data. While inDelphi achieves a mean held-out Pearson correlation of 0.851 on deletion genotype frequency prediction and 0.837 on deletion length frequency prediction, the linear baseline model achieves a mean held-out Pearson correlation of 0.816 on deletion genotype frequency prediction and 0.796 on deletion length frequency prediction. When including the third model component for 1-bp insertion modeling and testing on genotype frequency prediction for 1-bp insertions and all deletions, inDelphi achieves a median held-out Pearson correlation of 0.937 and 0.910 on the task of indel length frequency prediction. The linear baseline model achieves a median held-out Pearson correlation of 0.919 and 0.900 on the two tasks respectively.

From these results, it is shown that much of the model's power is derived from its designed structure which is independent of the choice of linear or non-linear modeling. While the baseline does not significantly cripple the model, the use of deep nonlinear neural networks offers a substantial performance improvement (10-24%) above linear modeling. In addition, the strong performance of the linear baseline model highlights that the prediction task, given the model structure, is relatively straightforward. This suggests that the model should be able to generalize well to unseen data.

The deep neural network version of MH-NN learns that microhomology length is more important than % GC (FIGS. 18A-18H). The linear version learns the same concept, with a weight of 1.1585 for MH length and 0.332 for % GC.

Comparison with a Baseline Model Lacking Microhomology Length as a Feature

Microhomology length is an important feature for MH-NN (FIGS. 18A-18H). A model was trained that uses only % GC as input to MH-NN while keeping the rest of the model structure identical. On held-out data, this baseline model at convergence achieves to a mean Pearson correlation of 0.59 on the task of predicting deletion genotype frequencies, and a mean Pearson correlation of 0.58 on the task of predicting deletion length frequencies. Notably, a model at iteration 0 with randomly initialized weights achieves mean Pearson correlations of 0.55 and 0.54 on the two respective tasks on held-out data. This basal Pearson correlation is relatively high due to the model structure, in particular, the exponential penalty on deletion length. In sum, removing MH length as a feature severely impacts model performance, restricting it to predictive performance not appreciably better than random chance.

inDelphi Training and Testing on Data from Varying Cell-Types

For predicting genotype and indel length frequencies in any particular cell-type C where data D is available, inDelphi's deletion component was first trained on a subset of Lib-A mESC data. Then, k-fold cross-validation was applied on D where D is iteratively split into training and test datasets. For each cross-validation iteration, the training set is used to train the insertion frequency model (k-nearest neighbors) and insertion genotype model (matrix of observed probabilities of each inserted base given local sequence context, which is just the −4 nucleotide when the training dataset is small, and −5, −4 and −3 nucleotides when the training dataset is large). For each cross-validation iteration, predictions are made at each sequence context in the test set which are compared to observations for each sequence context to yield a Pearson correlation. For any particular sequence context, the median test-time Pearson correlation across all cross-validation iterations is used as a single number summary of the overall performance of inDelphi. For all reported results, 100-fold cross-validation was used with 80%/20% training and testing splits. Empirically, small variance in test-time Pearson correlation was observed, highlighting the stability of inDelphi's modeling approach.

inDelphi Testing on Endogenous VO Data

On this task, the deletion component of inDelphi was trained on a subset of the Lib-A mESC data. For each cell type in HCT116, K562, and HEK293T, all VO sequence contexts (about 100) were randomly split into training and test datasets 100 times. During each split, the training set was used for k-nearest neighbor modeling of 1-bp insertion frequencies. Feature normalization to zero mean and unit variance was not performed. The average frequency of each 1-bp insertion genotype was derived from the training set as well. For each of the ~100 sequence contexts, the median test-time Pearson correlation was used for plotting in FIGS. 13A-13D. Due to the small size of the training set, only the −4 nucleotide was used for modeling both the insertion frequency and insertion genotype frequencies.

inDelphi Testing on Library Data

On this task, the deletion component of inDelphi was trained on a subset of the Lib-A mESC data. The remaining test set was used for measuring test-time prediction performance on Lib-A. Nucleotides −5, −4, and −3 were used for the insertion genotype model. For testing on Lib-B, Lib-B was split into training and test datasets in the same manner as with VO data. Nucleotide −4 was used for the insertion genotype model. The median test-time Pearson correlation is used as a single number summary of the overall performance of inDelphi on any particular sequence context. For reporting predictive results in FIGS. 15A-15F, sequence contexts with low replicability (less than 0.85 Pearson correlation) in observed editing outcome frequencies were first removed.

inDelphi Training and Testing on Prkdc$^{-/-}$Lig4$^{-/-}$ Data inDelphi was trained on data from 946 Lib-A sequence contexts and tested on 168 held-out Lib-A sequence contexts. Nucleotide −4 was used for insertion rate modeling, all other modeling choices were standard as described above. On held-out data, this version of inDelphi achieved a median Pearson correlation of 0.84 on predicting indel genotype frequencies, and 0.80 on predicting indel length frequencies.

Training the Online Public Version of inDelphi and its Expected Properties

For general-use on arbitrary cell types, a version of inDelphi was trained using additional data from diverse types of cells. Deletion modeling was trained using data from 2,464 sequence contexts from high-replicability Lib-A and Lib-B data (including clinical variants and microduplications, fourbp, and longdup) in mES and data from VO sequence contexts in HEK293 and K562. Insertion frequency modeling is implemented as above. Insertion genotype modeling uses nucleotides −5, −4, and −3. The insertion frequency model and insertion genotype model are trained on VO endogenous data in K562 and HEK293T, Lib-A data in mESC, and Lib-B data (including clinical variants and microduplications, fourbp, and longdup) in mESC and U2OS.

Though MHless-NN, as trained on library data, never receives information on deletion lengths beyond 28, it was allowed to generalize its learned function and make predictions on deletion lengths up to 60 bp to match the supported range of MH-NN.

inDelphi makes predictions on 1-bp insertions and 1–60-bp deletions, which were empirically shown to consist of higher than 90% of all Cas9 editing outcomes in data from multiple human and mouse cell lines. Nevertheless, there is a subset of repair (about 8% on average) that inDelphi does not attempt to predict. It is suggested that end-users, depending on what predictive quantities are of interest, take this into account when using inDelphi. For example, if inDelphi predicts that 60% of 1-bp insertions and 1–60-bp deletions at a disease allele correspond to repair to wildtype genotype, a quantity of interest may be the rate of wildtype repair in all Cas9 editing outcomes (including the 8% not predicted by inDelphi). In such a situation, this quantity can be calculated as (92%*60%)=55.2%.

By the design of 1872 sequence contexts in Lib-A, the training dataset has rich and uniform representation across all quintiles of several major axes of variation including GC content, precision, and number of bases participating in microhomology as measured empirically in the human genome. This design strategy enables inDelphi to generalize well to arbitrary sequence contexts from the human genome.

These training data further include data in the outlier range of statistics of interest, including extremely high and low precision repair distributions, and extremely weak and strong microhomology (minimal microhomology and extensive microduplication microhomology sequences). The availability of such sequences in the training data enables inDelphi to generalize well to sequence contexts of clinical interest and sequence contexts supporting unusually high frequencies of precision repair. In particular, by training on more than 1000 examples of repair at clinical microduplications, inDelphi has received strong preparation for accurate prediction on other clinical microduplications.

By training on data from many cell-types, inDelphi was enabled to make predictions that are generally applicable to many human cell-types. It is noted that the HCT116 human colon cancer cell line experiences a markedly higher frequency of single base insertions compared to all other cell lines that were studied, possibly due to the MLH1 deficiency of this cell line leading to impaired DNA mismatch repair. For this reason, HCT116 data was excluded from the training dataset. For best results, it is suggested that end-users keep in mind that repair class frequencies can be cell type-dependent, and this issue has not been well-characterized thus far.

It is noted that inDelphi's main error tendency is on the side of overestimating rather than underestimating the precision of repair (FIGS. 14A-14F, FIGS. 15A-15F). In general, this tendency can be explained by noting that inDelphi only considers sequence microhomology as a factor, while it's plausible and likely in biological experimental settings that even sequence contexts with very strong sequence microhomology may not yield precise results due to noise factors that are not considered by inDelphi. For best results, it is recommended that end-users take this tendency into account when using inDelphi predictions for further experiments. In particular, if gRNAs are designed by using a minimum precision threshold, end-users should recognize that observed repair outcomes may have empirical precision under this threshold. However, conversely, it is unlikely that a gRNA will have precision higher than what inDelphi predicts.

Lib-A Design (See Table 4)

All designed sequence contexts were 55 bp in length with cutting between the $27^{th}$ and $_{28}$th base.

1872 sequence contexts were designed by empirically determining the distribution of four statistics in sequence contexts from the human genome. These four statistics are GC content, total sum of bases participating in microhomology for 3–27-bp deletions, Azimuth predicted on-target efficiency score, and the statistical entropy of the predicted 3–27-bp deletion length distribution from a previous version of inDelphi. For each of these statistics, empirical quintiles were derived by calculating these statistics in a large number of sequence contexts from the human genome. For the library, sequence contexts were designed by randomly generated DNA that categorized into each combination of quintiles across each of the four statistics. For example, a sequence context falling into the $1^{st}$ quintile in GC, $2^{nd}$ quintile of total MH, $1^{st}$ quintile of Azimuth score, and $5^{th}$ quintile of entropy, was found by random search. With four statistics and five bins each (due to quintiles), there are $5^4$=625 possible combinations. For each combination, it was attempted to design three sequence contexts for a total of 1875; 3 sequences could not be designed (for a total of 1872) though each bin was filled. 90 sequence contexts were designed from VO sequence contexts. Other sequence contexts were also designed for a total of 2000 sequence contexts in Lib-A. Lib-A sequence names, gRNAs, and sequence contexts are listed in Table 4 (appended, forming part of the instant specification).

Lib-B Design (See Table 5)

All designed sequence contexts were 55 bp in length with cutting between the $27^{th}$ and $28^{th}$ base.

1592 sequence contexts were designed from Clinvar and HGMD (see section on Selection of variants from disease databases). Some disease sequence contexts were designed that such that the corrected wildtype or frameshift allele supports further cutting by the original gRNA; data from such sequence contexts were ignored during analysis. 57 "longdup" sequence contexts were designed by repeating the following procedure three times: for N=7 to 25, an N-mer was randomly generated, then duplicating and surrounded by randomly generated sequences, while ensuring that SpCas9 NGG was included and appropriately positioned for cutting between positions 27 and 28. 90 sequence contexts were designed from VO sequence contexts. 228 "fourbp" sequence contexts were designed at 3 contexts with random sequences (with total phi score on average lower than VO sequence contexts) while varying positions −5 to −2; for each of the 3 "low-microhomology" contexts, 76 four bases were randomly designed while ensuring representation from all possible 2 bp microhomology patterns including no microhomology, one base of microhomology at either position, and full two bases of microhomology. Other sequence contexts were also designed for a total of 2000 sequence contexts in Lib-B. Lib-B sequence names, gRNAs, and sequence contexts are listed in Table 5.

Generating a DNA Motif for 1-Bp Insertion Frequencies

Nucleotides from positions −7 to 0 were one-hot-encoded and used in ridge regression to predict the observed frequency of 1-bp insertions out of all Cas9 editing events in 1996 sequence contexts from Lib-A mESC data. The data were split into training and testing sets (80/20 split) 10,000 times to calculate a bootstrapped estimate of linear regression weights and test-set predictive Pearson correlation. The median test-set Pearson correlation was found to be 0.62. To generate a DNA motif, any features that included 0 within the bootstrapped weight range were excluded (probability that the weight is zero >1e-4). The average bootstrapped weight estimate was used as the "logo height" for all remaining features. Each feature is independent; vertical stacking of features follows the published tradition of DNA motifs.

```
Plasmid and insert sequences
P2T-CAG-MCS-P2A-GFP-PuroR complete plasmid sequence
                                             (SEQ ID NO: 41)
CCACCTAAATTGTAAGCGTTAATATTTTGTTAAAATTCGCGTTAAATTTTTGTTAAAT

CAGCTCATTTTTTAACCAATAGGCCGAAATCGGCAAAATCCCTTATAAATCAAAAGA

ATAGACCGAGATAGGGTTGAGTGTTGTTCCAGTTTGGAACAAGAGTCCACTATTAA

AGAACGTGGACTCCAACGTCAAAGGGCGAAAAACCGTCTATCAGGGCGATGGCCC

ACTACGTGAACCATCACCCTAATCAAGTTTTTTGGGGTCGAGGTGCCGTAAAGCAC

TAAATCGGAACCCTAAAGGGAGCCCCCGATTTAGAGCTTGACGGGGAAAGCCGGC

GAACGTGGCGAGAAAGGAAGGGAAGAAAGCGAAAGGAGCGGGCGCTAGGGCGC

TGGCAAGTGTAGCGGTCACGCTGCGCGTAACCACCACACCCGCCGCGCTTAATGC

GCCGCTACAGGGCGCGTCCCATTCGCCATTCAGGCTGCGCAACTGTTGGGAAGG

GCGATCGGTGCGGGCCTCTTCGCTATTACGCCAGCTGGCGAAAGGGGGATGTGC

TGCAAGGCGATTAAGTTGGGTAACGCCAGGGTTTTCCCAGTCACGACGTTGTAAAA

CGACGGCCAGTGAGCGCGCGTAATACGACTCACTATAGGGCGAATTGGGTACCG

GCATATGGTTCTTGACAGAGGTGTAAAAAGTACTCAAAAATTTTACTCAAGTGAAAG

TACAAGTACTTAGGGAAAATTTTACTCAATTAAAAGTAAAAGTATCTGGCTAGAATC

TTACTTGAGTAAAAGTAAAAAAGTACTCCATTAAAATTGTACTTGAGTATTAAGGAA

GTAAAAGTAAAAGCAAGAAAGATCGATCTCGAAGGATCTGGAGGCCACCATGGTG

TCGATAACTTCGTATAGCATACATTATACGAAGTTATCGTGCTCGACATTGATTATT

GACTAGTTATTAATAGTAATCAATTACGGGGTCATTAGTTCATAGCCCATATATGGA

GTTCCGCGTTACATAACTTACGGTAAATGGCCCGCCTGGCTGACCGCCCAACGAC

CCCCGCCCATTGACGTCAATAATGACGTATGTTCCCATAGTAACGCCAATAGGGAC

TTTCCATTGACGTCAATGGGTGGAGTATTTACGGTAAACTGCCCACTTGGCAGTAC

ATCAAGTGTATCATATGCCAAGTACGCCCCCTATTGACGTCAATGACGGTAAATGG

CCCGCCTGGCATTATGCCCAGTACATGACCTTATGGGACTTTCCTACTTGGCAGTA

CATCTACGTATTAGTCATCGCTATTACCATGGTCGAGGTGAGCCCCACGTTCTGCT

TCACTCTCCCCATCTCCCCCCCCTCCCCACCCCCAATTTTGTATTTATTTATTTTTTA

ATTATTTTGTGCAGCGATGGGGCGGGGGGGGGGGGGGGCGCGCGCCAGGCG

GGGCGGGGCGGGGCGAGGGGCGGGGCGGGGCGAGGCGGAGAGGTGCGGCGG

CAGCCAATCAGAGCGGCGCGCTCCGAAAGTTTCCTTTTATGGCGAGGCGGCGGC

GGCGGCGGCCCTATAAAAAGCGAAGCGCGCGGCGGGCGGGGAGTCGCTGCGAC
```

-continued

```
GCTGCCTTCGCCCCGTGCCCCGCTCCGCCGCCGCCTCGCGCCGCCCGCCCCGG

CTCTGACTGACCGCGTTACTCCCACAGGTGAGCGGGCGGGACGGCCCTTCTCCTC

CGGGCTGTAATTAGCGCTTGGTTTAATGACGGCTTGTTTCTTTTCTGTGGCTGCGT

GAAAGCCTTGAGGGGCTCCGGGAGGGCCCTTTGTGCGGGGGGAGCGGCTCGGG

GGGTGCGTGCGTGTGTGTGCGTGGGGAGCGCCGCGTGCGGCTCCGCGCTGC

CCGGCGGCTGTGAGCGCTGCGGGCGCGGCGCGGGGCTTTGTGCGCTCCGCAGT

GTGCGCGAGGGGAGCGCGGCCGGGGGCGGTGCCCCGCGGTGCGGGGGGGCT

GCGAGGGGAACAAAGGCTGCGTGCGGGGTGTGTGCGTGGGGGGGTGAGCAGGG

GGTGTGGGCGCGTCGGTCGGGCTGCAACCCCCCCTGCACCCCCCTCCCCGAGTT

GCTGAGCACGGCCCGGCTTCGGGTGCGGGGCTCCGTACGGGGCGTGGCGCGGG

GCTCGCCGTGCCGGGCGGGGGTGGCGGCAGGTGGGGGTGCCGGGCGGGGCG

GGGCCGCCTCGGGCCGGGGAGGGCTCGGGGGAGGGGCGCGGCGGCCCCCGGA

GCGCCGGCGGCTGTCGAGGCGCGGCGAGCCGCAGCCATTGCCTTTTATGGTAAT

CGTGCGAGAGGGCGCAGGGACTTCCTTTGTCCCAAATCTGTGCGGAGCCGAAATC

TGGGAGGCGCCGCCGCACCCCCTCTAGCGGGCGCGGGGCGAAGCGGTGCGGCG

CCGGCAGGAAGGAAATGGGCGGGGAGGGCCTTCGTGCGTCGCCGCGCCGCCGT

CCCCTTCTCCCTCTCCAGCCTCGGGGCTGTCCGCGGGGGACGGCTGCCTTCGG

GGGGGACGGGGCAGGGCGGGGTTCGGCTTCTGGCGTGTGACCGGCGGCTCTAG

AGCCTCTGCTAACCATGTTCATGCCTTCTTCTTTTTCCTACAGCTCCTGGGCAACGT

GCTGGTTATTGTGCTGTCTCATCATTTTGGCAAAGAATTCCTCGAGCGGCCGCCAG

TGTGATGGATATCGGATCCGCTAGCGCTACTAACTTCAGCCTGCTGAAGCAGGCT

GGAGACGTGGAGGAGAACCCTGGACCTGGACCGGTCGCCACCATGGTGAGCAAG

GGCGAGGAGCTGTTCACCGGGGTGGTGCCCATCCTGGTCGAGCTGGACGGCGAC

GTAAACGGCCACAAGTTCAGCGTGTCCGGCGAGGGCGAGGGCGATGCCACCTAC

GGCAAGCTGACCCTGAAGTTCATCTGCACCACCGGCAAGCTGCCCGTGCCCTGG

CCCACCCTCGTGACCACCCTGACCTACGGCGTGCAGTGCTTCAGCCGCTACCCCG

ACCACATGAAGCAGCACGACTTCTTCAAGTCCGCCATGCCCGAAGGCTACGTCCA

GGAGCGCACCATCTTCTTCAAGGACGACGGCAACTACAAGACCCGCGCCGAGGT

GAAGTTCGAGGGCGACACCCTGGTGAACCGCATCGAGCTGAAGGGCATCGACTT

CAAGGAGGACGGCAACATCCTGGGGCACAAGCTGGAGTACAACTACAACAGCCAC

AACGTCTATATCATGGCCGACAAGCAGAAGAACGGCATCAAGGTGAACTTCAAGAT

CCGCCACAACATCGAGGACGGCAGCGTGCAGCTCGCCGACCACTACCAGCAGAA

CACCCCCATCGGCGACGGCCCCGTGCTGCTGCCCGACAACCACTACCTGAGCAC

CCAGTCCGCCCTGAGCAAAGACCCCAACGAGAAGCGCGATCACATGGTCCTGCTG

GAGTTCGTGACCGCCGCCGGGATCACTCTCGGCATGGACGAGCTGTACAAGTAAA

GCGGCCGCCACCGCGGTGGAGCTCGAATTAATTCATCGATGATGATCCAGACATG

ATAAGATACATTGATGAGTTTGGACAAACCACAACTAGAATGCAGTGAAAAAAATG

CTTTATTTGTGAAATTTGTGATGCTATTGCTTTATTTGTAACCATTATAAGCTGCAAT

AAACAAGTTAACAACAACAATTGCATTCATTTTATGTTTCAGGTTCAGGGGGAGGTG

TGGGAGGTTTTTTAAAGCAAGTAAAACCTCTACAAATGTGGTATGGCTGATTATGAT
```

-continued

```
CCTCTAGAGTCGGTGGGCCTCGGGGGCGGGTGCGGGGTCGGCGGGGCCGCCCC

GGGTGGCTTCGGTCGGAGCCATGGGGTCGTGCGCTCCTTTCGGTCGGGCGCTGC

GGGTCGTGGGGCGGGCGTCAGGCACCGGGCTTGCGGGTCATGCACCAGGTGCG

CGGTCCTTCGGGCACCTCGACGTCGGCGGTGACGGTGAAGCCGAGCCGCTCGTA

GAAGGGGAGGTTGCGGGGCGCGGAGGTCTCCAGGAAGGCGGGCACCCCGGCGC

GCTCGGCCGCCTCCACTCCGGGGAGCACGACGGCGCTGCCCAGACCCTTGCCCT

GGTGGTCGGGCGAGACGCCGACGGTGGCCAGGAACCACGCGGGCTCCTTGGGC

CGGTGCGGCGCCAGGAGGCCTTCCATCTGTTGCTGCGCGGCCAGCCGGGAACCG

CTCAACTCGGCCATGCGCGGGCCGATCTCGGCGAACACCGCCCCCGCTTCGACG

CTCTCCGGCGTGGTCCAGACCGCCACCGCGGCGCCGTCGTCCGCGACCCACACC

TTGCCGATGTCGAGCCCGACGCGCGTGAGGAAGAGTTCTTGCAGCTCGGTGACC

CGCTCGATGTGGCGGTCCGGGTCGACGGTGTGGCGCGTGGCGGGGTAGTCGGC

GAACGCGGCGGCGAGGGTGCGTACGGCCCGGGGGACGTCGTCGCGGGTGGCGA

GGCGCACCGTGGGCTTGTACTCGGTCATGGAAGGTCGTCTCCTTGTGAGGGGTCA

GGGGCGTGGGTCAGGGGATGGTGGCGGCACCGGTCGTGGCGGCCGACCTGCAG

GCATGCAAGCTTTTTGCAAAAGCCTAGGCCTCCAAAAAAGCCTCCTCACTACTTCT

GGAATAGCTCAGAGGCCGAGGCGGCCTCGGCCTCTGCATAAATAAAAAAAATTAG

TCAGCCATGGGGCGGAGAATGGGCGGAACTGGGCGGAGTTAGGGGCGGGATGG

GCGGAGTTAGGGGCGGGACTATGGTTGCTGACTAATTGAGATGCATGCTTTGCAT

ACTTCTGCCTGCTGGGGAGCCTGGGGACTTTCCACACCTGGTTGCTGACTAATTG

AGATGCATGCTTTGCATACTTCTGCCTGCTGGGGAGCCTGGGGACTTTCCACACC

CTAACTGACACACATTCCACAGAATTCAAGTGATCTCCAAAAAATAAGTACTTTTTG

ACTGTAAATAAAATTGTAAGGAGTAAAAAGTACTTTTTTTCTAAAAAAATGTAATT

AAGTAAAAGTAAAAGTATTGATTTTTAATTGTACTCAAGTAAAGTAAAAATCCCCAA

AAATAATACTTAAGTACAGTAATCAAGTAAAATTACTCAAGTACTTTACACCTCTGG

TTCTTGACCCCCTACCTTCAGCAAGCCCAGCAGATCCGAGCTCCAGCTTTTGTTCCCT

TTAGTGAGGGTTAATTGCGCGCTTGGCGTAATCATGGTCATAGCTGTTTCCTGTGTG

AAATTGTTATCCGCTCACAATTCCACACAACATACGAGCCGGAAGCATAAAGTGTA

AAGCCTGGGGTGCCTAATGAGTGAGCTAACTCACATTAATTGCGTTGCGCTCACTG

CCCGCTTTCCAGTCGGGAAACCTGTCGTGCCAGCTGCATTAATGAATCGGCCAAC

GCGCGGGGAGAGGCGGTTTGCGTATTGGGCGCTCTTCCGCTTCCTCGCTCACTGA

CTCGCTGCGCTCGGTCGTTCGGCTGCGGCGAGCGGTATCAGCTCACTCAAAGGC

GGTAATACGGTTATCCACAGAATCAGGGGATAACGCAGGAAAGAACATGTGAGCA

AAAGGCCAGCAAAAGGCCAGGAACCGTAAAAAGGCCGCGTTGCTGGCGTTTTTCC

ATAGGCTCCGCCCCCCTGACGAGCATCACAAAAATCGACGCTCAAGTCAGAGGTG

GCGAAACCCGACAGGACTATAAAGATACCAGGCGTTTCCCCCTGGAAGCTCCCTC

GTGCGCTCTCCTGTTCCGACCCTGCCGCTTACCGGATACCTGTCCGCCTTTCTCC

CTTCGGGAAGCGTGGCGCTTTCTCATAGCTCACGCTGTAGGTATCTCAGTTCGGT

GTAGGTCGTTCGCTCCAAGCTGGGCTGTGTGCACGAACCCCCCGTTCAGCCCGAC

CGCTGCGCCTTATCCGGTAACTATCGTCTTGAGTCCAACCCGGTAAGACACGACTT

ATCGCCACTGGCAGCAGCCACTGGTAACAGGATTAGCAGAGCGAGGTATGTAGGC
```

-continued

```
GGTGCTACAGAGTTCTTGAAGTGGTGGCCTAACTACGGCTACACTAGAAGGACAG

TATTTGGTATCTGCGCTCTGCTGAAGCCAGTTACCTTCGGAAAAAGAGTTGGTAGC

TCTTGATCCGGCAAACAAACCACCGCTGGTAGCGGTGGTTTTTTTGTTTGCAAGCA

GCAGATTACGCGCAGAAAAAAAGGATCTCAAGAAGATCCTTTGATCTTTTCTACGG

GGTCTGACGCTCAGTGGAACGAAAACTCACGTTAAGGGATTTTGGTCATGAGATTA

TCAAAAAGGATCTTCACCTAGATCCTTTTAAATTAAAAATGAAGTTTTAAATCAATC

TAAAGTATATATGAGTAAACTTGGTCTGACAGTTACCAATGCTTAATCAGTGAGGCA

CCTATCTCAGCGATCTGTCTATTTCGTTCATCCATAGTTGCCTGACTCCCCGTCGTGT

AGATAACTACGATACGGGAGGGCTTACCATCTGGCCCCAGTGCTGCAATGATACC

GCGAGACCCACGCTCACCGGCTCCAGATTTATCAGCAATAAACCAGCCAGCCGGA

AGGGCCGAGCGCAGAAGTGGTCCTGCAACTTTATCCGCCTCCATCCAGTCTATTA

ATTGTTGCCGGGAAGCTAGAGTAAGTAGTTCGCCAGTTAATAGTTTGCGCAACGTT

GTTGCCATTGCTACAGGCATCGTGGTGTCACGCTCGTCGTTTGGTATGGCTTCATT

CAGCTCCGGTTCCCAACGATCAAGGCGAGTTACATGATCCCCCATGTTGTGCAAAA

AAGCGGTTAGCTCCTTCGGTCCTCCGATCGTTGTCAGAAGTAAGTTGGCCGCAGT

GTTATCACTCATGGTTATGGCAGCACTGCATAATTCTCTTACTGTCATGCCATCCGT

AAGATGCTTTTCTGTGACTGGTGAGTACTCAACCAAGTCATTCTGAGAATAGTGTAT

GCGGCGACCGAGTTGCTCTTGCCCGGCGTCAATACGGGATAATACCGCGCCACAT

AGCAGAACTTTAAAAGTGCTCATCATTGGAAAACGTTCTTCGGGGCGAAAACTCTC

AAGGATCTTACCGCTGTTGAGATCCAGTTCGATGTAACCCACTCGTGCACCCAACT

GATCTTCAGCATCTTTTACTTTCACCAGCGTTTCTGGGTGAGCAAAAACAGGAAGG

CAAAATGCCGCAAAAAAGGGAATAAGGGCGACACGGAAATGTTGAATACTCATACT

CTTCCTTTTTCAATATTATTGAAGCATTTATCAGGGTTATTGTCTCATGAGCGGATAC

ATATTTGAATGTATTTAGAAAAATAAACAAATAGGGGTTCCGCGCACATTTCCCCGA

AAAGTG
```

LDLRwt (SEQ ID NO: 42)
```
ATGGGGCCCTGGGGCTGGAAATTGCGCTGGACCGTCGCCTTGCTCCTCGCCGCG

GCGGGGACTGCAGTGGGCGACAGATGCGAAAGAAACGAGTTCCAGTGCCAAGAC

GGGAAATGCATCTCCTACAAGTGGGTCTGCGATGGCAGCGCTGAGTGCCAGGATG

GCTCTGATGAGTCCCAGGAGACGTGCTTGTCTGTCACCTGCAAATCCGGGGACTT

CAGCTGTGGGGCCGTGTCAACCGCTGCATTCCTCAGTTCTGGAGGTGCGATGGC

CAAGTGGACTGCGACAACGGCTCAGACGAGCAAGGCTGTCCCCCCAAGACGTGC

TCCCAGGACGAGTTTCGCTGCCACGATGGGAAGTGCATCTCTCGGCAGTTCGTCT

GTGACTCAGACCGGGACTGCTTGGACGGCTCAGACGAGGCCTCCTGCCCGGTGC

TCACCTGTGGTCCCGCCAGCTTCCAGTGCAACAGCTCCACCTGCATCCCCCAGCT

GTGGGCCTGCGACAACGACCCCGACTGCGAAGATGGCTCGGATGAGTGGCCGCA

GCGCTGTAGGGGTCTTTACGTGTTCCAAGGGGACAGTAGCCCCTGCTCGGCCTTC

GAGTTCCACTGCCTAAGTGGCGAGTGCATCCACTCCAGCTGGCGCTGTGATGGTG

GCCCCGACTGCAAGGACAAATCTGACGAGGAAAACTGCGCTGTGGCCACCTGTCG

CCCTGACGAATTCCAGTGCTCTGATGGAAACTGCATCCATGGCAGCCGGCAGTGT
```

-continued

```
GACCGGGAATATGACTGCAAGGACATGAGCGATGAAGTTGGCTGCGTTAATGTGA

CACTCTGCGAGGGACCCAACAAGTTCAAGTGTCACAGCGGCGAATGCATCACCCT

GGACAAAGTCTGCAACATGGCTAGAGACTGCCGGGACTGGTCAGATGAACCCATC

AAAGAGTGCGGGACCAACGAATGCTTGGACAACAACGGCGGCTGTTCCCACGTCT

GCAATGACCTTAAGATCGGCTACGAGTGCCTGTGCCCCGACGGCTTCCAGCTGGT

GGCCCAGCGAAGATGCGAAGATATCGATGAGTGTCAGGATCCCGACACCTGCAGC

CAGCTCTGCGTGAACCTGGAGGGTGGCTACAAGTGCCAGTGTGAGGAAGGCTTC

CAGCTGGACCCCCACACGAAGGCCTGCAAGGCTGTGGGCTCCATCGCCTACCTCT

TCTTCACCAACCGGCACGAGGTCAGGAAGATGACGCTGGACCGGAGCGAGTACA

CCAGCCTCATCCCCAACCTGAGGAACGTGGTCGCTCTGGACACGGAGGTGGCCA

GCAATAGAATCTACTGGTCTGACCTGTCCCAGAGAATGATCTGCAGCACCCAGCTT

GACAGAGCCCACGGCGTCTCTTCCTATGACACCGTCATCAGCAGAGACATCCAGG

CCCCCGACGGGCTGGCTGTGGACTGGATCCACAGCAACATCTACTGGACCGACTC

TGTCCTGGGCACTGTCTCTGTTGCGGATACCAAGGGCGTGAAGAGGAAAACGTTA

TTCAGGGAGAACGGCTCCAAGCCAAGGGCCATCGTGGTGGATCCTGTTCATGGCT

TCATGTACTGGACTGACTGGGGAACTCCCGCCAAGATCAAGAAAGGGGGCCTGAA

TGGTGTGGACATCTACTCGCTGGTGACTGAAAACATTCAGTGGCCCAATGGCATCA

CCCTAGATCTCCTCAGTGGCCGCCTCTACTGGGTTGACTCCAAACTTCACTCCATC

TCAAGCATCGATGTCAATGGGGGCAACCGGAAGACCATCTTGGAGGATGAAAAGA

GGCTGGCCCACCCCTTCTCCTTGGCCGTCTTTGAGGACAAAGTATTTTGGACAGAT

ATCATCAACGAAGCCATTTTCAGTGCCAACCGCCTCACAGGTTCCGATGTCAACTT

GTTGGCTGAAAACCTACTGTCCCCAGAGGATATGGTCCTCTTCCACAACCTCACCC

AGCCAAGAGGAGTGAACTGGTGTGAGAGGACCACCCTGAGCAATGGCGGCTGCC

AGTATCTGTGCCTCCCTGCCCCGCAGATCAACCCCCACTCGCCCAAGTTTACCTG

CGCCTGCCCGGACGGCATGCTGCTGGCCAGGGACATGAGGAGCTGCCTCACAGA

GGCTGAGGCTGCAGTGGCCACCCAGGAGACATCCACCGTCAGGCTAAAGGTCAG

CTCCACAGCCGTAAGGACACAGCACACAACCACCCGGCCTGTTCCCGACACCTCC

CGGCTGCCTGGGGCCACCCCTGGGCTCACCACGGTGGAGATAGTGACAATGTCT

CACCAAGCTCTGGGCGACGTTGCTGGCAGAGGAAATGAGAAGAAGCCCAGTAGC

GTGAGGGCTCTGTCCATTGTCCTCCCCATCGTGCTCCTCGTCTTCCTTTGCCTGGG

GGTCTTCCTTCTATGGAAGAACTGGCGGCTTAAGAACATCAACAGCATCAACTTTG

ACAACCCCGTCTATCAGAAGACCACAGAGGATGAGGTCCACATTTGCCACAACCA

GGACGGCTACAGCTACCCCTCGAGACAGATGGTCAGTCTGGAGGATGACGTGGCG

LDLRDup252 with surrounding region
                                                  (SEQ ID NO: 43)
CCCCCAAGACGTGCTCCCAGGACGAGTTTCGCTGCCACGATGGGAAGTGCATCTC

TCGGCAGTTCGTCTGTGACTCAGACCGGGACTGCTTGGACGGCTCAGACGAGGC

CTCCTGCCCGGTGCTCACCTGTGGTCCCGCCAGCTTCCAGTGCAACAGCTCCACC

TGCATCCCCCAGCTGTGGGCCTGCGACAACGACCCCGACTGCGAAGATGGCTCG

GAGGCTCGGATGAGTGGCCGCAGCGCTGTAGGGGTCTTTACGTGTTCCAAGGGG
```

```
-continued
ACAGTAGCCCCTGCTCGGCCTTCGAGTTCCACTGCCTAAGTGGCGAGTGCATCCA

CTCCAGCTGGCGCTGTGATGGTGGCCCCGACTGCAAGGACAAATCTGACGAGGA

AAACTGCG

LDLRDup254/255 with surrounding region
                                                          (SEQ ID NO: 44)
CCCCCAAGACGTGCTCCCAGGACGAGTTTCGCTGCCACGATGGGAAGTGCATCTC

TCGGCAGTTCGTCTGTGACTCAGACCGGGACTGCTTGGACGGCTCAGACGAGGC

CTCCTGCCCGGTGCTCACCTGTGGTCCCGCCAGCTTCCAGTGCAACAGCTCCACC

TGCATCCCCCAGCTGTGGGCCTGCGACAACGACCCCGACTGCGAAGATGGCTCG

GATGAGTGGCCGCAGCGCTGTAGGGGTCTTTACGTGTTCCAAGGGGACAGTAGC

CCCTGCTCGGCCTTCGAGTTCCACTGCCTAAGTGGCGAGTGCATCCACTCCAGCT

GGCGCTGTGATGGTGGCCCCGACTGCAAGGACAAATCTGACAGGACAAATCTGAC

GAGGAAAACTGCGCTGTGGCCACCTGTCGCCCTGACGAATTCCAGTGCTCTGATG

GAAACTGCATCCATG

LDLRDup258 with surrounding region
                                                          (SEQ ID NO: 45)
CCCCCAAGACGTGCTCCCAGGACGAGTTTCGCTGCCACGATGGGAAGTGCATCTC

TCGGCAGTTCGTCTGTGACTCAGACCGGGACTGCTTGGACGGCTCAGACGAGGC

CTCCTGCCCGGTGCTCACCTGTGGTCCCGCCAGCTTCCAGTGCAACAGCTCCACC

TGCATCCCCCAGCTGTGGGCCTGCGACAACGACCCCGACTGCGAAGATGGCTCG

GATGAGTGGCCGCAGCGCTGTAGGGGTCTTTACGTGTTCCAAGGGGACAGTAGC

CCCTGCTCGGCCTTCGAGTTCCACTGCCTAAGTGGCGAGTGCATCCACTCCAGCT

GGCGCTGTGATGGTGGCCCCGACTGCAAGGACAAATCTGAGGACAAATCTGACGA

GGAAAACTGCGCTGTGGCCACCTGTCGCCCTGACGAATTCCAGTGCTCTGATGGA

AACTGCATCCATG

LDLRDup261 with surrounding region
                                                          (SEQ ID NO: 46)
CCCCCAAGACGTGCTCCCAGGACGAGTTTCGCTGCCACGATGGGAAGTGCATCTC

TCGGCAGTTCGTCTGTGACTCAGACCGGGACTGCTTGGACGGCTCAGACGAGGC

CTCCTGCCCGGTGCTCACCTGTGGTCCCGCCAGCTTCCAGTGCAACAGCTCCACC

TGCATCCCCCAGCTGTGGGCCTGCGACAACGACCCCGACTGCGAAGATGGCTCG

GATGAGTGGCCGCAGCGCTGTAGGGGTCTTTACGTGTTCCAAGGGGACAGTAGC

CCCTGCTCGGCCTTCGAGTTCCACTGCCTAAGTGGCGAGTGCATCCACTCCAGCT

GGCGCTGTGATGGTGGCCCCGACTGCAAGGACAAATCTGACGACAAATCTGACGA

GGAAAACTGCGCTGTGGCCACCTGTCGCCCTGACGAATTCCAGTGCTCTGATGGA

AACTGCATCCATG

LDLRDup264 with surrounding region
                                                          (SEQ ID NO: 47)
CTTCATGTACTGGACTGACTGGGGAACTCCCGCCAAGATCAAGAAAGGGGGCCTG

AATGGTGTGGACATCTACTCGCTGGTGAGCTGGTGACTGAAAACATTCAGTGGCC

CAATGGCATCACCCTAG

GAAwt
                                                          (SEQ ID NO: 48)
ATGGGAGTGAGGCACCCGCCCTGCTCCCACCGGCTCCTGGCCGTCTGCGCCCTC

GTGTCCTTGGCAACCGCTGCACTCCTGGGGCACATCCTACTCCATGATTTCCTGCT

GGTTCCCCGAGAGCTGAGTGGCTCCTCCCCAGTCCTGGAGGAGACTCACCCAGCT
```

-continued

```
CACCAGCAGGGAGCCAGCAGACCAGGGCCCCGGGATGCCCAGGCACACCCCGG

CCGTCCCAGAGCAGTGCCCACACAGTGCGACGTCCCCCCCAACAGCCGCTTCGA

TTGCGCCCTGACAAGGCCATCACCCAGGAACAGTGCGAGGCCCGCGGCTGTTG

CTACATCCCTGCAAAGCAGGGGCTGCAGGGAGCCCAGATGGGGCAGCCCTGGTG

CTTCTTCCCACCCAGCTACCCCAGCTACAAGCTGGAGAACCTGAGCTCCTCTGAAA

TGGGCTACACGGCCACCCTGACCCGTACCACCCCCACCTTCTTCCCCAAGGACAT

CCTGACCCTGCGGCTGGACGTGATGATGGAGACTGAGAACCGCCTCCACTTCACG

ATCAAAGATCCAGCTAACAGGCGCTACGAGGTGCCCTTGGAGACCCCGCATGTCC

ACAGCCGGGCACCGTCCCCACTCTACAGCGTGGAGTTCTCCGAGGAGCCCTTCG

GGGTGATCGTGCGCCGGCAGCTGGACGGCCGCGTGCTGCTGAACACGACGGTG

GCGCCCCTGTTCTTTGCGGACCAGTTCCTTCAGCTGTCCACCTCGCTGCCCTCGC

AGTATATCACAGGCCTCGCCGAGCACCTCAGTCCCCTGATGCTCAGCACCAGCTG

GACCAGGATCACCCTGTGGAACCGGGACCTTGCGCCCACGCCCGGTGCGAACCT

CTACGGGTCTCACCCTTTCTACCTGGCGCTGGAGGACGGCGGGTCGGCACACGG

GGTGTTCCTGCTAAACAGCAATGCCATGGATGTGGTCCTGCAGCCGAGCCCTGCC

CTTAGCTGGAGGTCGACAGGTGGGATCCTGGATGTCTACATCTTCCTGGGCCCAG

AGCCCAAGAGCGTGGTGCAGCAGTACCTGGACGTTGTGGGATACCCGTTCATGCC

GCCATACTGGGGCCTGGGCTTCCACCTGTGCCGCTGGGGCTACTCCTCCACCGCT

ATCACCCGCCAGGTGGTGGAGAACATGACCAGGGCCCACTTCCCCCTGGACGTC

CAGTGGAACGACCTGGACTACATGGACTCCCGGAGGGACTTCACGTTCAACAAGG

ATGGCTTCCGGGACTTCCCGGCCATGGTGCAGGAGCTGCACCAGGGCGGCCGGC

GCTACATGATGATCGTGGATCCTGCCATCAGCAGCTCGGGCCCTGCCGGGAGCTA

CAGGCCCTACGACGAGGGTCTGCGGAGGGGGGTTTTCATCACCAACGAGACCGG

CCAGCCGCTGATTGGGAAGGTATGGCCCGGGTCCACTGCCTTCCCCGACTTCACC

AACCCCACAGCCCTGGCCTGGTGGGAGGACATGGTGGCTGAGTTCCATGACCAG

GTGCCCTTCGACGGCATGTGGATTGACATGAACGAGCCTTCCAACTTCATCAGGG

GCTCTGAGGACGGCTGCCCCAACAATGAGCTGGAGAACCCACCCTACGTGCCTG

GGGTGGTTGGGGGGACCCTCCAGGCGGCCACCATCTGTGCCTCCAGCCACCAGT

TTCTCTCCACACACTACAACCTGCACAACCTCTACGGCCTGACCGAAGCCATCGCC

TCCCACAGGGCGCTGGTGAAGGCTCGGGGGACACGCCCATTTGTGATCTCCCGC

TCGACCTTTGCTGGCCACGGCCGATACGCCGGCCACTGGACGGGGGACGTGTGG

AGCTCCTGGGAGCAGCTCGCCTCCTCCGTGCCAGAAATCCTGCAGTTTAACCTGC

TGGGGGTGCCTCTGGTCGGGGCCGACGTCTGCGGCTTCCTGGGCAACACCTCAG

AGGAGCTGTGTGTGCGCTGGACCCAGCTGGGGGCCTTCTACCCCTTCATGCGGAA

CCACAACAGCCTGCTCAGTCTGCCCCAGGAGCCGTACAGCTTCAGCGAGCCGGC

CCAGCAGGCCATGAGGAAGGCCCTCACCCTGCGCTACGCACTCCTCCCCCACCT

CTACACACTGTTCCACCAGGCCCACGTCGCGGGGGAGACCGTGGCCCGGCCCCT

CTTCCTGGAGTTCCCCAAGGACTCTAGCACCTGGACTGTGGACCACCAGCTCCTG

TGGGGGGAGGCCCTGCTCATCACCCCAGTGCTCCAGGCCGGGAAGGCCGAAGTG

ACTGGCTACTTCCCCCTTGGGCACATGGTACGACCTGCAGACGGTGCCAGTAGAGG
```

-continued

```
CCCTTGGCAGCCTCCCACCCCCACCTGCAGCTCCCCGTGAGCCAGCCATCCACAG

CGAGGGGCAGTGGGTGACGCTGCCGGCCCCCTGGACACCATCAACGTCCACCT

CCGGGCTGGGTACATCATCCCCCTGCAGGGCCCTGGCCTCACAACCACAGAGTC

CCGCCAGCAGCCCATGGCCCTGGCTGTGGCCCTGACCAAGGGTGGGGAGGCCC

GAGGGGAGCTGTTCTGGGACGATGGAGAGAGCCTGGAAGTGCTGGAGCGAGGG

GCCTACACACAGGTCATCTTCCTGGCCAGGAATAACACGATCGTGAATGAGCTGG

TACGTGTGACCAGTGAGGGAGCTGGCCTGCAGCTGCAGAAGGTGACTGTCCTGG

GCGTGGCCACGGCGCCCCAGCAGGTCCTCTCCAACGGTGTCCCTGTCTCCAACTT

CACCTACAGCCCCGACACCAAGGTCCTGGACATCTGTGTCTCGCTGTTGATGGGA

GAGCAGTTTCTCGTCAGCTGGTGT
```

GAADup327/328

(SEQ ID NO: 49)

```
ATGGGAGTGAGGCACCCGCCCTGCTCCCACCGGCTCCTGGCCGTCTGCGCCCTC

GTGTCCTTGGCAACCGCTGCACTCCTGGGGCACATCCTACTCCATGATTTCCTGCT

GGTTCCCCGAGAGCTGAGTGGCTCCTCCCCAGTCCTGGAGGAGACTCACCCAGCT

CACCAGCAGGGAGCCAGCAGACCAGGGCCCCGGGATGCCCAGGCACACCCCGG

CCGTCCCAGAGCAGTGCCCACACAGTGCGACGTCCCCCCCAACAGCCGCTTCGA

TTGCGCCCCTGACAAGGCCATCACCCAGGAACAGTGCGAGGCCCGCGGCTGTTG

CTACATCCCTGCAAAGCAGGGGCTGCAGGGAGCCCAGATGGGGCAGCCCTGGTG

CTTCTTCCCACCCAGCTACCCCAGCTACAAGCTGGAGAACCTGAGCTCCTCTGAAA

TGGGCTACACGGCCACCCTGACCCGTACCACCCCCACCTTCTTCCCCAAGGACAT

CCTGACCCTGCGGCTGGACGTGATGATGGAGACTGAGAACCGCCTCCACTTCACG

ATCAAAGATCCAGCTAACAGGCGCTACGAGGTGCCCTTGGAGACCCCGCATGTCC

ACAGCCGGGCACCGTCCCCACTCTACAGCGTGGAGTTCTCCGAGGAGCCCTTCG

GGGTGATCGTGCGCCGGCAGCTGGACGGCCGCGTGCTGCTGAACACGACGGTG

GCGCCCCTGTTCTTTGCGGACCAGTTCCTTCAGCTGTCCACCTCGCTGCCCTCGC

AGTATATCACAGGCCTCGCCGAGCACCTCAGTCCCCTGATGCTCAGCACCAGCTG

GACCAGGATCACCCTGTGGAACCGGGACCTTGCGCCCACGCCCGGTGCGAACCT

CTACGGGTCTCACCCTTTCTACCTGGCGCTGGAGGACGGCGGGTCGGCACACGG

GGTGTTCCTGCTAAACAGCAATGCCATGGATGTGGTCCTGCAGCCGAGCCCTGCC

CTTAGCTGGAGGTCGACAGGTGGGATCCTGGATGTCTACATCTTCCTGGGCCCAG

AGCCCAAGAGCGTGGTGCAGCAGTACCTGGACGTTGTGGGATACCCGTTCATGCC

GCCATACTGGGGCCTGGGCTTCCACCTGTGCCGCTGGGGCTACTCCTCCACCGCT

ATCACCCGCCAGGTGGTGGAGAACATGACCAGGGCCCACTTCCCCCTGGACGTC

CAGTGGAACGACCTGGACTACATGGACTCCCGGAGGGACTTCACGTTCAACAAGG

ATGGCTTCCGGGACTTCCCGGCCATGGTGCAGGAGCTGCACCAGGGCGGCCGGC

GCTACATGATGATCGTGGATCCTGCCATCAGCAGCTCGGGCCCTGCCGGGAGCTA

CAGGCCCTACGACGAGGGTCTGCGGAGGGGGGTTTTCATCACCAACGAGACCGG

CCAGCCGCTGATTGGGAAGGTATGGCCCGGGTCCACTGCCTTCCCCGACTTCACC

AACCCCACAGCCCTGGCCTGGTGGGAGGACATGGTGGCTGAGTTCCATGACCAG

GTGCCCTTCGACGGCATGTGGATTGACATGAACGAGCCTTCCAACTTCATCAGGG

GCTCTGAGGACGGCTGCCCCAACAATGAGCTGGAGAACCCACCCTACGTGCCTG
```

```
GGGTGGTTGGGGGGACCCTCCAGGCGGCCACCATCTGTGCCTCCAGCCACCAGT

TTCTCTCCACACACTACAACCTGCACAACCTCTACGGCCTGACCGAAGCCATCGCC

TCCCACAGGGCGCTGGTGAAGGCTCGGGGGACACGCCCATTTGTGATCTCCCGC

TCGACCTTTGCTGGCCACGGCCGATACGCCGGCCACTGGACGGGGGACGTGTGG

AGCTCCTGGGAGCAGCTCGCCTCCTCCGTGCCAGAAATCCTGCAGTTTAACCTGC

TGGGGGTGCCTCTGGTCGGGGCCGACGTCTGCGGCTTCCTGGGCAACACCTCAG

AGGAGCTGTGTGTGCGCTGGACCCAGCTGGGGGCCTTCTACCCCTTCATGCGGAA

CCACAACAGCCTGCTCAGTCTGCCCCAGGAGCCGTACAGCTTCAGCGAGCCGGC

CCAGCAGGCCATGAGGAAGGCCCTCACCCTGCGCTACGCACTCCTCCCCCACCT

CTACACACTGTTCCACCAGGCCCACGTCGCGGGGGAGACCGTGGCCCGGCCCCT

CTTCCTGGAGTTCCCCAAGGACTCTAGCACCTGGACTGTGGACCACCAGCTCCTG

TGGGGGGAGGCCCTGCTCATCACCCCAGTGCTCCAGGCCGGGAAGGCCGAAGTG

ACTGGCTACTTCCCCTTGGGCACATGGTACGACCTGCAGACGGTGCCAGTAGAGG

CCCTTGGCAGCCTCCCACCCCCACCTGCAGCTCCCCGTGAGCCAGCCATCCACAG

CGAGGGGCAGTGGGTGACGCTGCCGGCCCCCTGGACACCATCAACGTCCACCT

CCGGGCTGGGTACATCATCCCCCTGCAGGGCCCTGGCCTCACAACCACAGAGTC

CCGCCAGCAGCCCATGGCCCTGGCTGTGGCCCTGACCAAGGGTGGGGAGGCCC

GAGGGGAGCTGTTCTGGGACGATGGAGAGAGCCTGGAAGTGCTGGAGCGAGGG

GCCTACACACAGGTCATCTTCCTGGCCAGGAATAACACGATCGTGAATGAGCTGG

TACGTGTGACCAGTGAGGGAGCTGGCCTGCAGCTGCAGAAGGTGACTGCAGAAG

GTGACTGTCCTGGGCGTGGCCACGGCGCCCCAGCAGGTCCTCTCCAACGGTGTC

CCTGTCTCCAACTTCACCTACAGCCCCGACACCAAGGTCCTGGACATCTGTGTCTC

GCTGTTGATGGGAGAGCAGTTTCTCGTCAGCTGGTGT
```

GLB1wt

```
                                                        (SEQ ID NO: 50)
ATGCCGGGGTTCCTGGTTCGCATCCTCCCTCTGTTGCTGGTTCTGCTGCTTCTGG

GCCCTACGCGCGGCTTGCGCAATGCCACCCAGAGGATGTTTGAAATTGACTATAG

CCGGGACTCCTTCCTCAAGGATGGCCAGCCATTTCGCTACATCTCAGGAAGCATTC

ACTACTCCCGTGTGCCCCGCTTCTACTGGAAGGACCGGCTGCTGAAGATGAAGAT

GGCTGGGCTGAACGCCATCCAGACGTATGTGCCCTGGAACTTTCATGAGCCCTGG

CCAGGACAGTACCAGTTTTCTGAGGACCATGATGTGGAATATTTTCTTCGGCTGGC

TCATGAGCTGGGACTGCTGGTTATCCTGAGGCCCGGGCCCTACATCTGTGCAGAG

TGGGAAATGGGAGGATTACCTGCTTGGCTGCTAGAGAAAGAGTCTATTCTTCTCCG

CTCCTCCGACCCAGATTACCTGGCAGCTGTGGACAAGTGGTTGGGAGTCCTTCTG

CCCAAGATGAAGCCTCTCCTCTATCAGAATGGAGGGCCAGTTATAACAGTGCAGG

TTGAAAATGAATATGGCAGCTACTTTGCCTGTGATTTTGACTACCTGCGCTTCCTGC

AGAAGCGCTTTCGCCACCATCTGGGGGATGATGTGGTTCTGTTTACCACTGATGGA

GCACATAAAACATTCCTGAAATGTGGGGCCCTGCAGGGCCTCTACACCACGGTGG

ACTTTGGAACAGGCAGCAACATCACAGATGCTTTCCTAAGCCAGAGGAAGTGTGA

GCCCAAAGGACCCTTGATCAATTCTGAATTCTATACTGGCTGGCTAGATCACTGGG

GCCAACCTCACTCCACAATCAAGACCGAAGCAGTGGCTTCCTCCCTCTATGATATA
```

-continued
CTTGCCCGTGGGGCGAGTGTGAACTTGTACATGTTTATAGGTGGGACCAATTTTGC

CTATTGGAATGGGGCCAACTCACCCTATGCAGCACAGCCCACCAGCTACGACTAT

GATGCCCCACTGAGTGAGGCTGGGGACCTCACTGAGAAGTATTTTGCTCTGCGAA

ACATCATCCAGAAGTTTGAAAAAGTACCAGAAGGTCCTATCCCTCCATCTACACCA

AAGTTTGCATATGGAAAGGTCACTTTGGAAAAGTTAAAGACAGTGGGAGCAGCTCT

GGACATTCTGTGTCCCTCTGGGCCCATCAAAAGCCTTTATCCCTTGACATTTATCCA

GGTGAAACAGCATTATGGGTTTGTGCTGTACCGGACAACACTTCCTCAAGATTGCA

GCAACCCAGCACCTCTCTCTTCACCCCTCAATGGAGTCCACGATCGAGCATATGTT

GCTGTGGATGGGATCCCCCAGGGAGTCCTTGAGCGAAACAATGTGATCACTCTGA

ACATAACAGGGAAAGCTGGAGCCACTCTGGACCTTCTGGTAGAGAACATGGGACG

TGTGAACTATGGTGCATATATCAACGATTTTAAGGGTTTGGTTTCTAACCTGACTCT

CAGTTCCAATATCCTCACGGACTGGACGATCTTTCCACTGGACACTGAGGATGCAG

TGTGCAGCCACCTGGGGGGCTGGGGACACCGTGACAGTGGCCACCATGATGAAG

CCTGGGCCCACAACTCATCCAACTACACGCTCCCGGCCTTTTATATGGGGAACTTC

TCCATTCCCAGTGGGATCCCAGACTTGCCCCAGGACACCTTTATCCAGTTTCCTGG

ATGGACCAAGGGCCAGGTCTGGATTAATGGCTTTAACCTTGGCCGCTATTGGCCA

GCCCGGGGCCCTCAGTTGACCTTGTTTGTGCCCCAGCACATCCTGATGACCTCGG

CCCCAAACACCATCACCGTGCTGGAACTGGAGTGGGCACCCTGCAGCAGTGATGA

TCCAGAACTATGTGCTGTGACGTTCGTGGACAGGCCAGTTATTGGCTCATCTGTGA

CCTACGATCATCCCTCCAAACCTGTTGAAAAAAGACTCATGCCCCCACCCCCGCAA

AAAAACAAAGATTCATGGCTGGACCATGTA

GLB1Dup84

(SEQ ID NO: 51)
ATGCCGGGGTTCCTGGTTCGCATCCTCCCTCTGTTGCTGGTTCTGCTGCTTCTGG

GCCCTACGCGCGGCTTGCGCAATGCCACCCAGAGGATGTTTGAAATTGACTATAG

CCGGGACTCCTTCCTCAAGGATGGCCAGCCATTTCGCTACATCTCAGGAAGCATTC

ACTACTCCCGTGTGCCCCGCTTCTACTGGAAGGACCGGCTGCTGAAGATGAAGAT

GGCTGGGCTGAACGCCATCCAGACGTATGTGCCCTGGAACTTTCATGAGCCCTGG

CCAGGACAGTACCAGTTTTCTGAGGACCATGATGTGGAATATTTTCTTCGGCTGGC

TCATGAGCTGGGACTGCTGGTTATCCTGAGGCCCGGGCCCTACATCTGTGCAGAG

TGGGAAATGGGAGGATTACCTGCTTGGCTGCTAGAGAAAGAGTCTATTCTTCTCCG

CTCCTCCGACCCAGATTACCTGGCAGCTGTGGACAAGTGGTTGGGAGTCCTTCTG

CCCAAGATGAAGCCTCTCCTCTATCAGAATGGAGGGCCAGTTATAACAGTGCAGG

TTGAAAATGAATATGGCAGCTACTTTGCCTGTGATTTTGACTACCTGCGCTTCCTGC

AGAAGCGCTTTCGCCACCATCTGGGGGATGATGTGGTTCTGTTTACCACTGATGGA

GCACATAAAACATTCCTGAAATGTGGGGCCCTGCAGGGCCTCTACACCACGGTGG

ACTTTGGAACAGGCAGCAACATCACAGATGCTTTCCTAAGCCAGAGGAAGTGTGA

GCCCAAAGGACCCTTGATCAATTCTGAATTCTATACTGGCTGGCTAGATCACTGGG

GCCAACCTCACTCCACAATCAAGACCGAAGCAGTGGCTTCCTCCCTCTATGATATA

CTTGCCCGTGGGGCGAGTGTGAACTTGTACATGTTTATAGGTGGGACCAATTTTGC

CTATTGGAATGGGGCCAACTCACCCTATGCAGCACAGCCCACCAGCTACGACTAT

GATGCCCCACTGAGTGAGGCTGGGGACCTCACTGAGAAGTATTTTGCTCTGCGAA

-continued

```
ACATCATCCAGAAGTTTGAAAAAGTACCAGAAGGTCCTATCCCTCCATCTACACCA

AAGTTTGCATATGGAAAGGTCACTTTGGAAAAGTTAAAGACAGTGGGAGCAGCTCT

GGACATTCTGTGTCCCTCTGGGCCCATCAAAAGCCTTTATCCCTTGACATTTATCCA

GGTGAAACAGCATTATGGGTTTGTGCTGTACCGGACAACACTTCCTCAAGATTGCA

GCAACCCAGCACCTCTCTCTTCACCCCTCAATGGAGTCCACGATCGAGCATATGTT

GCTGTGGATGGGATCCCCCAGGGAGTCCTTGAGCGAAACAATGTGATCACTCTGA

ACATAACAGGGAAAGCTGGAGCCACTCTGGACCTTCTGGTAGAGAACATGGGACG

TGTGAACTATGGTGCATATATGGTGCATATATCAACGATTTTAAGGGTTTGGTTTCT

AACCTGACTCTCAGTTCCAATATCCTCACGGACTGGACGATCTTTCCACTGGACAC

TGAGGATGCAGTGTGCAGCCACCTGGGGGCTGGGGACACCGTGACAGTGGCCA

CCATGATGAAGCCTGGGCCCACAACTCATCCAACTACACGCTCCCGGCCTTTTATA

TGGGGAACTTCTCCATTCCCAGTGGGATCCCAGACTTGCCCCAGGACACCTTTATC

CAGTTTCCTGGATGGACCAAGGGCCAGGTCTGGATTAATGGCTTTAACCTTGGCC

GCTATTGGCCAGCCCGGGGCCCTCAGTTGACCTTGTTTGTGCCCCAGCACATCCT

GATGACCTCGGCCCCAAACACCATCACCGTGCTGGAACTGGAGTGGGCACCCTG

CAGCAGTGATGATCCAGAACTATGTGCTGTGACGTTCGTGGACAGGCCAGTTATT

GGCTCATCTGTGACCTACGATCATCCCTCCAAACCTGTTGAAAAAGACTCATGCC

CCCACCCCGCAAAAAAACAAAGATTCATGGCTGGACCATGTA
```

PORCNwt
(SEQ ID NO: 52)
```
ATGGCCACCTTTAGCCGCCAGGAATTTTTCCAGCAGCTACTGCAAGGCTGTCTCCT

GCCTACTGCCCAGCAGGGCCTTGACCAGATCTGGCTGCTCCTTGCCATCTGCCTC

GCCTGCCGCCTCCTCTGGAGGCTCGGGTTGCCATCCTACCTGAAGCATGCAAGCA

CCGTGGCAGGCGGGTTCTTCAGCCTCTACCACTTCTTCCAGCTGCACATGGTTTG

GGTCGTGCTGCTCAGCCTCCTGTGCTACCTCGTGCTGTTCCTCTGCCGACATTCCT

CCCATCGAGGCGTCTTCCTATCCGTCACCATCCTCATCTACCTACTCATGGGTGAG

ATGCACATGGTAGACACCGTGACATGGCACAAGATGCGAGGGGCACAGATGATTG

TGGCCATGAAGGCAGTGTCTCTGGGCTTCGACCTGGACCGGGGCGAGGTGGGTA

CGGTGCCCTCGCCAGTGGAGTTCATGGGCTACCTCTACTTCGTGGGCACCATCGT

CTTCGGGCCCTGGATATCCTTCCACAGCTACCTACAAGCTGTCCAAGGCCGCCCA

CTGAGCTGCCGGTGGCTGCAGAAGGTGGCCCGGAGCCTGGCACTGGCCCTGCTG

TGCCTTGTGCTGTCCACTTGCGTGGGCCCCTACCTCTTCCCGTACTTCATCCCCCT

CAACGGTGACCGCCTCCTTCGCAAGGGCACCATGGTAAGGTGGCTGCGAGCCTA

CGAGAGTGCTGTCTCCTTCCACTTCAGCAACTATTTTGTGGGCTTTCTTTCCGAGG

CCACGGCCACGTTGGCGGGGCTGGCTTTACCGAGGAGAAGGATCACCTGGAAT

GGGACCTGACGGTGTCCAAGCCACTGAATGTGGAGCTGCCTCGGTCAATGGTGG

AAGTTGTCACAAGCTGGAACCTGCCCATGTCTTATTGGCTAAATAACTATGTTTTCA

AGAATGCTCTCCGCCTGGGGACCTTCTCGGCTGTGCTGGTCACCTATGCAGCCAG

CGCCCTCCTACATGGCTTCAGTTTCCACCTGGCTGCGGTCCTGCTGTCCCTGGCT

TTTATCACTTACGTGGAGCATGTCCTCCGGAAGCGCCTGGCTCGGATCCTCAGTG

CCTGTGTCTTGTCAAAGCGGTGCCCGCCAGACTGTTCGCACCAGCATCGCTTGGG
```

```
                                  -continued
CCTGGGGGTGCGAGCCTTAAACTTGCTCTTTGGAGCTCTGGCCATCTTCCACCTG

GCCTACCTGGGCTCCCTGTTTGATGTCGATGTGGATGACACCACAGAGGAGCAGG

GCTACGGCATGGCATACACTGTCCACAAGTGGTCAGAGCTCAGCTGGGCCAGTCA

CTGGGTCACTTTTGGATGCTGGATCTTCTACCGTCTCATAGGC

PORCNDup20
                                                            (SEQ ID NO: 53)
ATGGCCACCTTTAGCCGCCAGGAATTTTTCCAGCAGCTACTGCAAGGCTGTCTCCT

GCCTACTGCCCAGCAGGGCCTTGACCAGATCTGGCTGCTCCTTGCCATCTGCCTC

GCCTGCCGCCTCCTCTGGAGGCTCGGGTTGCCATCCTACCTGAAGCATGCAAGCA

CCGTGGCAGGCGGGTTCTTCAGCCTCTACCACTTCTTCCAGCTGCACATGGTTTG

GGTCGTGCTGCTCAGCCTCCTGTGCTACCTCGTGCTGTTCCTCTGCCGACATTCCT

CCCATCGAGGCGTCTTCCTATCCGTCACCATCCTCATCTACCTACTCATGGGTGAG

ATGCACATGGTAGACACCGTGACATGGCACAAGATGCGAGGGGCACAGATGATTG

TGGCCATGAAGGCAGTGTCTCTGGGCTTCGACCTGGACCGGGGCGAGGTGGGTA

CGGTGCCCTCGCCAGTGGAGTTCATGGGCTACCTCTACTTCGTGGGCACCATCGT

CTTCGGGCCCTGGATATCCTTCCACAGCTACCTACAAGCTGTCCAAGGCCGCCCA

CTGAGCTGCCGGTGGCTGCAGAAGGTGGCCCGGAGCCTGGCACTGGCCCTGCTG

TGCCTTGTGCTGTCCACTTGCGTGGGCCCCTACCTCTTCCCGTACTTCATCCCCCT

CAACGGTGACCGCCTCCTTCGCAAGGGCACCATGGTAAGGTGGCTGCGAGCCTA

CGAGAGTGCTGTCTCCTTCCACTTCAGCAACTATTTTGTGGGCTTTCTTTCCGAGG

CCACGGCCACGTTGGCGGGGGCTGGCTTTACCGAGGAGAAGGATCACCTGGAAT

GGGACCTGACGGTGTCCAAGCCACTGAATGTGGAGCTGCCTCGGTCAATGGTGG

AAGTTGTCACAAGCTGGAACCTGCCCATGTCTTATTGGCTAAATAACTATGTTTTCA

AGAATGCTCTCCGCCTGGGGACCTTCTCGGCTGTGCTGGTCACCTATGCAGCCAG

CGCCCTCCTACATGGCTTCAGTTTCCACCTGGCTGCGGTCCTGCTGTCCCTGGCT

TTTATCCCTGGCTTTTATCACTTACGTGGAGCATGTCCTCCGGAAGCGCCTGGCTC

GGATCCTCAGTGCCTGTGTCTTGTCAAAGCGGTGCCCGCCAGACTGTTCGCACCA

GCATCGCTTGGGCCTGGGGGTGCGAGCCTTAAACTTGCTCTTTGGAGCTCTGGCC

ATCTTCCACCTGGCCTACCTGGGCTCCCTGTTTGATGTCGATGTGGATGACACCAC

AGAGGAGCAGGGCTACGGCATGGCATACACTGTCCACAAGTGGTCAGAGCTCAG

CTGGGCCAGTCACTGGGTCACTTTTGGATGCTGGATCTTCTACCGTCTCATAGGC
```

EXECUTIVE SUMMARY

It was found that template-free DNA repair of Cas9-cleaved and Cpf1-cleaved DNA produces a predictable set of repair genotypes that can result in the gain-of-function repair of human disease mutations. Contrary to the assumption that end-joining following double-strand breaks is random and difficult to harness for applications beyond gene disruption, here it is shown that template-free end-joining repair of DNA cleaved by CRISPR-associated nucleases produces a predictable set of repair genotypes. A library of 2000 guide RNAs paired with target DNA sites was constructed, and they were integrated into mouse and human genomes, applied Cas9, and performed high-throughput sequencing of repair genotypes. Data from this assay are consistent with results from 98 endogenous loci. Building upon prior work, it is shown that the majority of repair genotypes in cells with saturated exposure to both CRISPR-Cas9 and Cpf1 are deletions associated with sequence microhomology. Using 1,588 sequence contexts from the data, CRISPR-Texture, a machine learning method that accurately predicted the frequencies of template-free Cas9-mediated microhomology-associated deletions as well as 1 bp insertions, was trained. On 282 held-out sequence contexts, CRISPR-Texture predicted frameshift rates more accurately than published methods and accurately predicted the statistical entropy of repair product distributions. Applied to the human genome, CRISPR-Texture identified an appreciable fraction of Cas9 target sites supporting high-precision repair distributions that are dominated by a single genotype. Further, it was found that a class of human disease-associated micro-duplication mutations can be repaired to wildtype at high frequency by template-free Cas9 nuclease editing and used the assay to validate hundreds of such alleles. Template-free Cas9 nuclease-mediated rescue of pathogenic LDLR alleles to wildtype phenotype in cellular models was also validated. This work establishes a strategy for predicting the outcomes of template-free end-joining and demonstrates that CRISPR editing can also mediate efficient gain-of-function editing at certain disease alleles without homology-directed repair.

REFERENCES

1. Cong, L. et al. Multiplex Genome Engineering Using CRISPR/Cas Systems. *Science* 339, 819 (2013).
2. Mali, P. et al. RNA-Guided Human Genome Engineering via Cas9. *Science* 339, 823-826 (2013).
3. Jinek, M. et al. RNA-programmed genome editing in human cells. *eLife* 2, e00471 (2013).
4. Doench, J. G. et al. Optimized sgRNA design to maximize activity and minimize off-target effects of CRISPR-Cas9. *Nat. Biotechnol.* 34, 1-12 (2016).
5. Kleinstiver, B. P. et al. High-fidelity CRISPR-Cas9 nucleases with no detectable genome-wide off-target effects. *Nature* 529, 490-495 (2016).
6. Slaymaker, I. M. et al. Rationally engineered Cas9 nucleases with improved specificity. *Science* 351, 84-88 (2016).
7. Fu, Y., Sander, J. D., Reyon, D., Cascio, V. M. & Joung, J. K. Improving CRISPR-Cas nuclease specificity using truncated guide RNAs. *Nat. Biotechnol.* 32, 279-284 (2014).
8. Kleinstiver, B. P. et al. Engineered CRISPR-Cas9 nucleases with altered PAM specificities. *Nature* 523, 481-485 (2015).
9. Kleinstiver, B. P. et al. Broadening the targeting range of *Staphylococcus aureus* CRISPR-Cas9 by modifying PAM recognition. *Nat. Biotechnol.* 33, 1293-1298 (2015).
10. Hu, J. H. et al. Evolved Cas9 variants with broad PAM compatibility and high DNA specificity. *Nature* 1-24 (2018). doi:10.1038/nature26155
11. Komor, A. C., Kim, Y. B., Packer, M. S., Zuris, J. A. & Liu, D. R. Programmable editing of a target base in genomic DNA without double-stranded DNA cleavage. *Nature* 533, 420-424 (2016).
12. Gaudelli, N. M. et al. Programmable base editing of A•T to G•C in genomic DNA without DNA cleavage. *Nature* 1-27 (2017). doi:10.1038/nature24644
13. Chu, V. T. et al. Increasing the efficiency of homology-directed repair for CRISPR-Cas9-induced precise gene editing in mammalian cells. *Nat. Biotechnol.* 33, 543-548 (2015).
14. Richardson, C. D., Ray, G. J., DeWitt, M. A., Curie, G. L. & Corn, J. E. Enhancing homology-directed genome editing by catalytically active and inactive CRISPR-Cas9 using asymmetric donor DNA. *Nat. Biotechnol.* 34, 339-344 (2016).
15. Paquet, D. et al. Efficient introduction of specific homozygous and heterozygous mutations using CRISPR/Cas9. *Nature* 533, 1-18 (2016).
16. Landrum, M. J. et al. ClinVar: Public archive of interpretations of clinically relevant variants. *Nucleic Acids Res.* 44, D862-D868 (2016).
17. Stenson, P. D. et al. Human Gene Mutation Database: towards a comprehensive central mutation database. *J. Med. Genet.* 45, 124 (2008).
18. Shin, H. Y. et al. CRISPR/Cas9 targeting events cause complex deletions and insertions at 17 sites in the mouse genome. *Nat. Commun.* 8, 1-10 (2017).
19. Sakuma, T., Nakade, S., Sakane, Y., Suzuki, K.-I. T. & Yamamoto, T. MMEJ-assisted gene knock-in using TALENs and CRISPR-Cas9 with the PITCh systems. *Nat. Protoc.* 11, 118-133 (2015).
20. Suzuki, K. et al. In vivo genome editing via CRISPR/Cas9 mediated homology-independent targeted integration. *Nature* 540, 144-149 (2016).
21. Nakade, S. et al. Microhomology-mediated end-joining-dependent integration of donor DNA in cells and animals using TALENs and CRISPR/Cas9. *Nat. Commun.* 5, 5560-5560 (2014).
22. Kraft, K. et al. Deletions, Inversions, Duplications: Engineering of Structural Variants using CRISPR/Cas in Mice. *Cell Rep.* 10, 833-839.
23. Koike-Yusa, H., Li, Y., Tan, E.-P., Velasco-Herrera, M. D. C. & Yusa, K. Genome-wide recessive genetic screening in mammalian cells with a lentiviral CRISPR-guide RNA library. *Nat. Biotechnol.* 32, 267-273 (2013).
24. van Overbeek, M. et al. DNA Repair Profiling Reveals Nonrandom Outcomes at Cas9-Mediated Breaks. *Mol. Cell* 63, 633-646 (2016).
25. Urasaki, A., Morvan, G. & Kawakami, K. Functional dissection of the Tol2 transposable element identified the minimal cis-sequence and a highly repetitive sequence in the subterminal region essential for transposition. *Genetics* 174, 639-649 (2006).
26. Ceccaldi, R., Rondinelli, B. & D'Andrea, A. D. Repair Pathway Choices and Consequences at the Double-Strand Break. *Spec. Issue Qual. Control* 26, 52-64 (2016).
27. Deriano, L. & Roth, D. B. Modernizing the Nonhomologous End-Joining Repertoire: Alternative and Classical NHEJ Share the Stage. *Annu. Rev. Genet.* 47, 433-455 (2013).
28. Evers, B. et al. CRISPR knockout screening outperforms shRNA and CRISPRi in identifying essential genes. *Nat. Biotechnol.* 34, 631-633 (2016).
29. Bae, S., Kweon, J., Kim, H. S. & Kim, J.-S. Microhomology-based choice of Cas9 nuclease target sites. *Nat Methods* 11, 705-706 (2014).
30. Cornu, T. I., Mussolino, C. & Cathomen, T. Refining strategies to translate genome editing to the clinic. *Nat. Med.* 23, 415 (2017).
31. Shalem, O., Sanjana, N. E. & Zhang, F. High-throughput functional genomics using CRISPR-Cas9. *Nat. Rev. Genet.* 16, 299 (2015).
32. Mandal, P. K. et al. Efficient Ablation of Genes in Human Hematopoietic Stem and Effector Cells using CRISPR/Cas9. *Cell Stem Cell* 15, 643-652 (2014).
33. Tabebordbar, M. et al. In vivo gene editing in dystrophic mouse muscle and muscle stem cells. *Science* 351, 407 (2016).
34. Arbab, M., Srinivasan, S., Hashimoto, T., Geijsen, N. & Sherwood, R. I. Cloning-free CRISPR. *Stem Cell Rep.* 5, 908-917 (2015).
35. Davis, A. J. & Chen, D. J. DNA double strand break repair via non-homologous end-joining. *Transl. Cancer Res.* 2, 130-143 (2013).
36. Bourbon, M., Alves, A. C. & Sijbrands, E. J. Low-density lipoprotein receptor mutational analysis in diagnosis of familial hypercholesterolemia. *Curr. Opin. Lipidol.* 28, 120-129 (2017).
37. Ran, F. A. et al. In vivo genome editing using *Staphylococcus aureus* Cas9. *Nature* 520, 186 (2015).
38. Oh, J. et al. Positional cloning of a gene for Hermansky-Pudlak syndrome, a disorder of cytoplasmic organelles. *Nat. Genet.* 14, 300-306 (1996).

39. Orthwein, A. et al. A mechanism for the suppression of homologous recombination in G1 cells. *Nature* 528, 422 (2015).
40. Biehs, R. et al. DNA Double-Strand Break Resection Occurs during Non-homologous End Joining in G1 but Is Distinct from Resection during Homologous Recombination. *Mol. Cell* 671–684 (2017). doi:10.1016/j.molcel.2016.12.016
41. Zetsche, B. et al. Cpf1 Is a Single RNA-Guided Endonuclease of a Class 2 CRISPR-Cas System. *Cell* 163, 759–771 (2015).
42. Christian, M. et al. Targeting DNA Double-Strand Breaks with TAL Effector Nucleases. *Genetics* 186, 757 (2010).
43. Kim, Y. G., Cha, J. & Chandrasegaran, S. Hybrid restriction enzymes: zinc finger fusions to Fok I cleavage domain. *Proc. Natl. Acad. Sci.* 93, 1156 (1996).
44. Sherwood, R. I. et al. Discovery of directional and nondirectional pioneer transcription factors by modeling DNase profile magnitude and shape. *Nat. Biotechnol.* 32, 171–178 (2014).
45. DiCarlo, J. E., Chavez, A., Dietz, S. L., Esvelt, K. M. & Church, G. M. Safeguarding CRISPR-Cas9 gene drives in yeast. Nat. Biotechnol. 33, 1250 (2015).
46. McVey, M. & Lee, S. E. MMEJ repair of double-strand breaks (director's cut): deleted sequences and alternative endings. Trends Genet. 24, 529–538 (2008).
47. Yu, A. M. & McVey, M. Synthesis-dependent microhomology-mediated end joining accounts for multiple types of repair junctions. Nucleic Acids Res. 38, 5706–5717 (2010).
48. Heidenreich, E., Novotny, R., Kneidinger, B., Holzmann, V. & Wintersberger, U. Non; homologous end joining as an important mutagenic process in cell cycle; arrested cells. *EMBO J.* 22, 2274 (2003).
49. Pfeiffer, P., Goedecke, W. & Obe, G. Mechanisms of DNA double-strand break repair and their potential to induce chromosomal aberrations. Mutagenesis 15, 289–302 (2000).

Example 2: Workflow Description of Using inDelphi to Design Cas9 gRNAs for Efficient Genome Editing to Induce Exon Skipping One application of CRISPR-Cas9 for therapeutic purposes is to alter the genome to cause RNA editing to skip a pathogenic exon by changing the splicing regulatory sites controlling the inclusion of the pathogenic exon. In some cases, a single exon in a gene may contain a pathogenic variant, and the entire exon can be skipped to produce an alternative isoform with normal function. For example, certain cases of Duchenne muscular dystrophy (DMD) are caused by a deleterious mutation in exon 23 of the Dmd gene that results in a premature stop codon that produces a dysfunctional Dmd protein. To restore function the deleterious exon 23 can skipped by editing the DNA proximal to the diseased exon with a single gRNA (Long, 2016).

This Example tests a new method for selecting gRNAs for CRISPR editing to disrupt splice site sequences to cause the skipping of pathogenic exons to restore wild-type cellular function. Splice site acceptor DNA motifs occur at the boundary between introns and exons, depicted as 5'-intron-AG-exon-3', where the AG is a highly-conserved element of the splice site acceptor motif and is considered to reside in the intron. The splice site acceptor DNA motif is considered to be as long as 23 bp in length including the AG. Algorithms such as MaxEntScan (Yeo, 2004) receive as input a DNA sequence and output a numerical score representing how strongly the splice site acceptor motif is present at the DNA sequence.

CRISPR-Cas9 induces a DNA double-strand break at a specific location specified by the gRNA. DNA repair fixes the double-strand break, inducing insertions and deletions through non-homologous end-joining (NHEJ) and microhomology-mediated end-joining (MMEJ) when a homology template is not present for repair through homology-directed repair (HDR). InDelphi, as disclosed herein, predicts the frequency distribution of NHEJ/MMEJ-mediated repair genotypes following Cas9 cutting. In this Example, inDelphi's ability to predict the spectrum of repair genotypes is utilized to identify gRNAs that ablate the splice site acceptor motif at a high frequency out of all non-wild-type repair outcomes.

Other computational methods have focused on predicting on-target efficiency of CRISPR-Cas9 cutting. This Example aims to identify gRNAs that will efficiently cut and induce non-wild-type repair outcomes (otherwise described as high on-target activity). A relevant published method (Doench et al., 2016, Nature, aka "Azimuth") uses the DNA sequence surrounding the gRNA, as well as the position of the cutsite in the protein, to predict the gRNA's ability to knock out the protein as observed in gRNA enrichment in screens of cell-essential genes, where a higher score indicates higher gRNA cutting efficacy. However, Doench et al. does not directly predict the frequency of non-wild-type repair frequency. It is reasoned here that the frequency of protein knockdown depends on the rate of non-wild-type repair, and the rate of frameshift repair out of all non-wild-type repair outcomes. Despite this concern, gRNAs are filtered based on a minimum threshold Azimuth score in order to maximize the chances that selected gRNAs have high on-target activity (increase true positives), at the risk of filtering away some gRNAs that also have high on-target activity (increase false negatives). In alternative embodiments, this Azimuth filtering step may be skipped to decrease the rate of false negatives at the risk of decreasing the rate of true positives.

To more directly address the question of on-target efficiency, this Example developed an algorithm referred to as the Basic On-Target Model (BOTM) which directly predicts the frequency of non-wild-type observations from DNA sequence features. BOTM uses DNA sequence as input and outputs a predicted frequency of non-wild-type repair, where non-wild-type repair is defined as the sum frequency of CRISPR-associated deletions and insertions (defined as reads aligning to the reference with exactly one gap which resides within 1-bp of the cutsite, using alignment scores +1 match, −1 mismatch, −5 gap open, −0 gap extend), over the denominator of sum frequency of non-noise outcomes consisting of CRISPR-associated indels, wildtype repair, and reads with multiple indels with at least one occurring near the cutsite, and reads with exactly one indel occurring anywhere outside the cutsite). BOTM is implemented as an ensemble of 100 gradient boosted regression trees, each with maximum depth 3, that are fitted in consecutive stages on the negative gradient of the least squares loss function. BOTM uses the following input features: one-hot encoded nucleotides at positions −7 to 0 (such that "NGG" occupies positions 0 to 2), the GC fraction of the 40-bp window around the cutsite, and the following features from inDelphi: log phi score (microhomology score), precision score (ranging from 0 to 1, with 1 being more precise), expected value of the indel length distribution, the frequency of 1-bp insertions, microhomology deletions, and microhomology-less deletions, the highest frequency of any single 1-bp insertion outcome, the highest frequency of any single deletion outcome, and the highest frequency of any single outcome. Trained on deep sequencing data at 3,600 target sites from our genome-integrated library construct in mES also used to train inDelphi, BOTM achieves a Pearson correlation of 0.42 at predicting the observed frequency of non-wild-type repair on 400 held-out target sites from our genome-integrated library construct in mES. On held-out data, it was manually determined a BOTM predicted frequency of 0.65 or greater for gRNAs that have a high frequency of non-wildtype repair.

One computational workflow for identifying Cas9 gRNAs with clinical relevance for the correction of genetic diseases by inducing exon skipping consists of four steps: identify relevant exons, select gRNAs for these exons with effective targeting, determine the genotypic products of each gRNA using inDelphi, and select gRNAs with genotypic products that are predicted to disrupt the relevant splicing motif. Using this approach, we have identified 4000 gRNAs that target splice sites to correct genetic diseases (Appendix attached).

First, 6805 exons with the following characteristics were determined: the exon length is evenly divisible by 3 so that skipping them preserves frame; the exon contains at least one HGMD pathogenic indel, which are likely to disrupt normal protein function (basal frameshift rate ~66%, column "hgmd_indel_count" in Appendix spreadsheet); the exon is not constitutive, measured by <100% presence in Ensembl transcripts (Ensembl); and the exon does not contain an annotated protein domain in Pfam (Pfam). The last two criteria are used to identify exons that may not be essential for wild-type protein function. The resulting 6,805 exons were candidates for disease correction by exon skipping.

Then, SpCas9 gRNAs (NGG PAM) with cutsites in a 6 bp window surrounding and including the AG motif were selected, resulting in an average of 2.2 SpCas9 gRNAs per exon. We then ensured high predicted on-target editing efficiency by removing all gRNAs with Azimuth score below 0.20. (threshold set manually) or BOTM score below 0.65 which is chosen to separate gRNAs with high versus low frequencies of non-wild-type repair).

Each gRNA and exon target site for splice site motif disruption were scored. We obtained this prediction by first using inDelphi to predict the frequency distribution of 1-bp insertion and deletion (1–60 bp) genotypes resulting from template-free DNA repair of a CRISPR gRNA induced cut at the target exon site.

Finally, for each genotype predicted by inDelphi, we classified a genotype as "motif disrupting" when its MaxEntScan score is <0.9 of its unedited MaxEntScan score; otherwise we classified the genotype as "no effect". This classification ruleset was provided by (Tang, 2016) and validated on experimental splicing data to achieve a sensitivity of 83.6% and specificity of 79.2% (Tang, 2016). The total frequency of all motif-disruption repair genotypes was used to predict the splice site motif disruption frequency out of all inDelphi predicted genotypes.

The top 4000 gRNA and target site pairs were selected based on this predicted frequency of splice site disruptions. Long, 2016 identified several SpCas9 gRNAs that, in a mouse model of muscular dystrophy, restored some degree of dystrophin protein expression and improved skeletal muscle function by inducing exon skipping of exon 23 (containing a non-sense mutation) via NHEJ-mediated DNA repair of a Cas9-induced cut. Without considering the results of their experiments and focusing solely on the DNA sequence context and background biological knowledge, our computational workflow recognizes that exon 23 of DMD is a good candidate for disease correction via exon skipping: the exon has a length evenly divisible by 3, is associated with a pathogenic non-sense variant that destroys normal protein function, and is not constitutive or required for normal protein function. Long 2016 reports results for only one SpCas9 gRNA targeting the 5' end of exon 23 called sgRNA-L8 ATAATTTCTATTATATTACA (SEQ ID NO: 11590) with PAM GGG. In their experiments with sgRNA-L8, they observe 9/18 pups with exon 23 skipping. This gRNA targets mm10 chrX: 83,803,134–83,803,156 (minus strand), while the exon 23 boundary is 149-bp downstream at mm10 chrX: 83,803,305. This Example's computational workflow for now only identifies gRNAs cutting within a 6-bp window of the AG motif at the exon 5' boundary, so as described our workflow does not identify Long's sgRNA-L8. Other methods of selecting exons for splice site acceptor removal include selecting exons with mutant splice regulatory sites that result in the inappropriate inclusion of exons in RNA transcripts (Sterne-Weiler 2014). Alternatively, subsequent expressed exons can be skipped to restore reading frame. In this case, reading frame can be restored by skipping a subsequent expressed exon where the length of the subsequent skipped exon and the length of the indel sum to 0 mod 3. In addition, constitutive exons and/or exons known to contain annotated protein domains in Pfam can be selected for exon skipping as an alternative method for knocking out a gene.

Correcting Genetic Disorders Using Predictable CRISPR/Cas9-Induced Exon Skipping Exon skipping has emerged as a powerful method to restore gene function in a number of genetic disorders. These therapies force the splicing machinery to bypass exons that contain deleterious point mutations or frameshifts. The FDA has recently approved an antisense oligonucleotide therapy that induces exon skipping in Duchenne muscular dystrophy to restore dystrophin function, and several other related strategies have shown pre-clinical promise. Yet, oligonucleotide therapies are transient treatments that require frequent dosing.

CRISPR/Cas9 instead promises to alleviate genetic disease permanently, through genome alteration. Using a high-throughput experimental-computational pipeline, as described herein, the inventors have developed an algorithm capable of highly accurate prediction of CRISPR/Cas9 genotypic alterations. At a predictable subset of genomic target sites, CRISPR/Cas9 induces precise sequence deletions. These modifications are highly specific and have excellent potential for therapeutic genome editing through controlled deletion of splice-acceptor sites.

The inventors will systematically evaluate this new approach to treat genetic disorders using CRISPR/Cas9 deletions. At intron-exon junctions, we will induce small deletions to bypass exons containing deleterious variants that affect protein function or alter the reading frame. While not every splice site can be successfully deleted through CRISPR/Cas9 modification, and not every exon can be skipped without compromising gene function, the inventors expect that this approach will succeed in enough genes to have broad therapeutic implications.

To measure the applicability of this approach to treat disease throughout the genome, the inventors will establish a principled computational approach to identify exons known to harbor disease-causing mutations where omission is unlikely to impact gene function. The inventors will then apply a novel, high-throughput CRISPR/Cas9 assay that quantifies the impact of high-precision genome editing on splicing at thousands of these intron-exon boundaries. After determining a set of candidate exons that can be skipped efficiently, the inventors will measure the impact of CRISPR/Cas9-mediated exon skipping on transcript structure and gene function for dozens of human disease exons. This exhaustive approach promises to chart a systematic path toward classifying disease genes that would be most amenable for future pre-clinical evaluation of permanent therapeutic exon skipping.

Induce Exon Skipping Using CRISPR/Cas9 at Thousands of Exons that Harbor Disease Variants.

By mapping coding variants known to be associated with genetic disorders, the inventors will develop a set of exons whose skipping could feasibly provide clinical benefit. The inventors will use measures of selective constraint from large-scale population data and alternative splicing data to prioritize exons whose skipping is least likely to compromise protein function. Using the herein described algorithm which predicts the genotypic consequence of targeting with CRISPR/Cas9, the inventors will refine a list of up to 10,000 intron-exon boundaries where modification is predicted to induce exon skipping at high rates. To test these predictions in high-throughput, the inventors will adapt our CRISPR/Cas9 cutting assay to read out context-specific splicing outcomes in human cells in vitro. This novel assay will allow paired evaluation of CRISPR/Cas9 cutting genotype and splicing phenotype for hundreds of distinct replicates in each of 10,000 human exons. The inventors will perform this assay in several human cell lines and will computationally identify exons that can be skipped at high frequency for further study. The inventors will also explore Cas9 base-editing in the same high-throughput system to determine if splicing can be altered by single base alterations. Using these data, the inventors will derive computational rules for which sequence alterations do and do not lead to exon skipping.

Evaluate the Consequences of CRISPR/Cas9 Exon Skipping on Transcript Structure and Function.

Using results from the high-throughput assay, the inventors will select up to 100 exon-skipping guide RNAs to pursue in greater depth. The inventors will prioritize exons that are natively excluded from at least one experimentally validated splice isoform, that lack characterized protein domains, and that are under relaxed selective constraint. For these exons, the inventors will edit native genomes in an appropriate cell line given the gene function and disease process. By performing transcript-specific RNA deep sequencing, the inventors will determine the rate of exon skipping and the transcript structure after the exon is skipped, monitoring for the appearance of aberrant splice acceptors. The inventors will also assay the function of these genes with skipped exons, using appropriate cellular and biochemical assays for each gene. This analysis will identify a set of disease genes that are promising candidates for further study in mutated cell lines and animal models. Overall, this systematic study will elucidate which disease genes are compelling candidates for pre-clinical evaluation of CRISPR/Cas9-mediated exon skipping therapy.

REFERENCES

Long C, Amoasii L, Mireault A, McAnally J, Li H, Sanchez-Ortiz E, Bhattacharyya S, Shelton J, Bassel-Duby R, Olson E. Postnatal genome editing partially restores dystrophin expression in a mouse model of muscular dystrophy. Science 2016; 351 (6271): 400-403.

Yeo G, Burge CB. Maximum entropy modeling of short sequence motifs with applications to RNA splicing signals. J Comput Biol. 2004; 11(2-3):377-94.

John G. Doench*, Nicolo Fusi*, Meagan Sullender*, Mudra Hegde*, Emma W. Vaimberg*, Katherine F. Donovan, Ian Smith, Zuzana Tothova, Craig Wilen, Robert Orchard, Herbert W. Virgin, Jennifer Listgarten*, David E. Root. Optimized sgRNA design to maximize activity and minimize off-target effects for genetic screens with CRISPR-Cas9. Nature Biotechnology January 2016.

Rongying Tang, Debra O. Prosser, and Donald R. Love, "Evaluation of Bioinformatic Programmes for the Analysis of Variants within Splice Site Consensus Regions," Advances in Bioinformatics, vol. 2016, Article ID 5614058, 10 pages, 2016.

Sterne-Weiler T, Sanford J. Exon identity crisis: disease-causing mutations that disrupt the splicing code. Genome Biology 2014 15:201.

OTHER EMBODIMENTS

The foregoing has been a description of certain non-limiting embodiments of the invention. Those of ordinary skill in the art will appreciate that various changes and modifications to this description may be made without departing from the spirit or scope of the present invention, as defined in the following claims.

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

Furthermore, the invention encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the invention, or aspects of the invention, is/are referred to as comprising particular elements and/or features, certain embodiments of the invention or aspects of the invention consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the invention, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the instant specification, the specification shall control. In addition, any particular embodiment of the present invention that falls within the prior art may be explicitly excluded from any one or more of the claims. Because such embodiments are deemed to be known to one of ordinary skill in the art, they may be excluded even if the exclusion is not set forth explicitly herein. Any particular embodiment of the invention can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present invention, as defined in the following claims.

Lengthy table referenced here

US12406749-20250902-T00001

Please refer to the end of the specification for access instructions.

Lengthy table referenced here

US12406749-20250902-T00002

Please refer to the end of the specification for access instructions.

Lengthy table referenced here

US12406749-20250902-T00003

Please refer to the end of the specification for access instructions.

Lengthy table referenced here

US12406749-20250902-T00004

Please refer to the end of the specification for access instructions.

Lengthy table referenced here

US12406749-20250902-T00005

Please refer to the end of the specification for access instructions.

Lengthy table referenced here

US12406749-20250902-T00006

Please refer to the end of the specification for access instructions.

Lengthy table referenced here

US12406749-20250902-T00007

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US12406749B2). An electronic copy of the table will also be available from the USPTO upon request and payment of the fee set forth in 37 CFR 1.19(b)(3).

SEQUENCE LISTING (11591 sequences)

SEQ ID NO: 1 - DNA, 14 bp, Artificial Sequence
  Synthetic polynucleotide
aggacaaatctgac

SEQ ID NO: 2 - DNA, 12 bp, Artificial Sequence
  Synthetic polynucleotide
ggacaaatctga

SEQ ID NO: 3 - DNA, 12 bp, Artificial Sequence
  Synthetic polynucleotide
caaatctgacga

SEQ ID NO: 4 - DNA, 13 bp, Artificial Sequence
  Synthetic polynucleotide
cctggcttttatc

SEQ ID NO: 5 - DNA, 13 bp, Artificial Sequence
  Synthetic polynucleotide
cagaaggtgactg

SEQ ID NO: 6 - DNA, 11 bp, Artificial Sequence
  Synthetic polynucleotide
ggtgcatatat

SEQ ID NO: 7 - DNA, 10 bp, Artificial Sequence
  Synthetic polynucleotide
acgtgcatga

SEQ ID NO: 8 - DNA, 60 bp, Artificial Sequence
  Synthetic polynucleotide
tttttgttttctgtgttccgttgtccgtgctgtaacgaaaggatgggtgcgacgcgtcat

SEQ ID NO: 9 - DNA, 60 bp, Artificial Sequence
  Synthetic polynucleotide
gttgataacggactagccttatttaaacttgctatgctgtttccagcatagctcttaaac

SEQ ID NO: 10 - DNA, 25 bp, Artificial Sequence
  Synthetic polynucleotide
gtttaagagctatgctggaaacagc

SEQ ID NO: 11 - DNA, 71 bp, Artificial Sequence
  Synthetic polynucleotide
atgacgcgtcgcacccatcctttcgttacagcacggacaacggaacacagaaaacaaaaaagcaccgactc

SEQ ID NO: 12 - DNA, 60 bp, Artificial Sequence
  Synthetic polynucleotide
gtaacttgaaagtatttcgatttcttggctttatatatcttgtggaaaggacgaaacacc

SEQ ID NO: 13 - DNA, 89 bp, Artificial Sequence
  Synthetic polynucleotide
ttgtggtttgtccaaactcatcaatgtatcttatcatgtctgctcgaagcggccgtacctctagattcagacgtgtgctcttccgatct

SEQ ID NO: 14 - DNA, 14 bp, Artificial Sequence
  Synthetic polynucleotide
aggacaaatctgac

SEQ ID NO: 15 - DNA, 12 bp, Artificial Sequence
  Synthetic polynucleotide
ggacaaatctga

SEQ ID NO: 16 - DNA, 12 bp, Artificial Sequence
  Synthetic polynucleotide
caaatctgacga

SEQ ID NO: 17 - DNA, 13 bp, Artificial Sequence
  Synthetic polynucleotide
cctggcttttatc

SEQ ID NO: 18 - DNA, 11 bp, Artificial Sequence
  Synthetic polynucleotide
ggtgcatatat

SEQ ID NO: 19 - DNA, 13 bp, Artificial Sequence
  Synthetic polynucleotide
cagaaggtgactg

SEQ ID NO: 20 - DNA, 22 bp, Artificial Sequence
  Synthetic polynucleotide
gctgcgaagatggctcggaggc

SEQ ID NO: 21 - DNA, 22 bp, Artificial Sequence
  Synthetic polynucleotide
gtgcaaggacaaatctgacagg

SEQ ID NO: 22 - DNA, 22 bp, Artificial Sequence
  Synthetic polynucleotide
gttcctcgtcagatttgtcctg

SEQ ID NO: 23 - DNA, 22 bp, Artificial Sequence
  Synthetic polynucleotide
gactgcaaggacaaatctgagg

SEQ ID NO: 24 - DNA, 22 bp, Artificial Sequence
  Synthetic polynucleotide
gttttcctcgtcagatttgtcg

SEQ ID NO: 25 - DNA, 21 bp, Artificial Sequence
  Synthetic polynucleotide
gacatctactcgctggtgagc

SEQ ID NO: 26 - DNA, 21 bp, Artificial Sequence
  Synthetic polynucleotide
gctgtccctggcttttatccc

SEQ ID NO: 27 - DNA, 21 bp, Artificial Sequence
  Synthetic polynucleotide
gtgtgaactatggtgcatata

SEQ ID NO: 28 - DNA, 22 bp, Artificial Sequence
  Synthetic polynucleotide
gcagctgcagaaggtgactgca

SEQ ID NO: 29 - DNA, 21 bp, Artificial Sequence
  Synthetic polynucleotide
gctgcagaaggtgactgcaga

SEQ ID NO: 30 - DNA, 51 bp, Artificial Sequence
  Synthetic polynucleotide
  misc_feature (29)..(31): n is a, c, g, or t
ctttccctacacgacgctcttccgatctnnnactccagctggcgctgtgat

SEQ ID NO: 31 - DNA, 51 bp, Artificial Sequence
  Synthetic polynucleotide
ggagttcagacgtgtgctcttccgatctcaacttcatcgctcatgtccttg

SEQ ID NO: 32 - DNA, 54 bp, Artificial Sequence
  Synthetic polynucleotide
  misc_feature (29)..(31): n is a, c, g, or t
ctttccctacacgacgctcttccgatctnnnaactcccgccaagatcaagaaag

SEQ ID NO: 33 - DNA, 51 bp, Artificial Sequence
  Synthetic polynucleotide
ggagttcagacgtgtgctcttccgatctcagcctcttttcatcctccaaga

SEQ ID NO: 34 - DNA, 54 bp, Artificial Sequence
  Synthetic polynucleotide
  misc_feature (29)..(31): n is a, c, g, or t
ctttccctacacgacgctcttccgatctnnncctcctacatggcttcagtttcc

SEQ ID NO: 35 - DNA, 51 bp, Artificial Sequence
  Synthetic polynucleotide
ggagttcagacgtgtgctcttccgatctccagagctccaaagagcaagttt

SEQ ID NO: 36 - DNA, 53 bp, Artificial Sequence
  Synthetic polynucleotide
  misc_feature (29)..(31): n is a, c, g, or t
ctttccctacacgacgctcttccgatctnnnagccactctggaccttctggta

SEQ ID NO: 37 - DNA, 51 bp, Artificial Sequence
  Synthetic polynucleotide
ggagttcagacgtgtgctcttccgatctccagtccgtgaggatattggaac

SEQ ID NO: 38 - DNA, 54 bp, Artificial Sequence
  Synthetic polynucleotide
  misc_feature (29)..(31): n is a, c, g, or t
ctttccctacacgacgctcttccgatctnnngatcgtgaatgagctggtacgtg

SEQ ID NO: 39 - DNA, 51 bp, Artificial Sequence
  Synthetic polynucleotide
ggagttcagacgtgtgctcttccgatctaacagcgagacacagatgtccag

SEQ ID NO: 40 - DNA, 92 bp, Artificial Sequence
  Synthetic polynucleotide
gatgggtgcgacgcgtcatagatcggaagagcacacgtctgaatattgtggaaaggacgaaacaccggtttaagagctatgctggaaacagc

SEQ ID NO: 41 - DNA, 7383 bp, Artificial Sequence
  Synthetic polynucleotide
ccacctaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccggcatatggttcttgacagaggtgtaaaaagtactcaaaaattttactcaagtgaaagtacaagtacttagggaaaattttactcaattaaaagtaaaagtatctggctagaatcttacttgagtaaaagtaaaaaagtactccattaaaattgtacttgagtattaaggaagtaaaagtaaaagcaagaaagatcgatctcgaaggatctggaggccaccatggtgtcgataacttcgtatagcatacattatacgaagttatcgtgctcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggggagtcgctgcgacgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcctcgagcggccgccagtgtgatggatatcggatccgctagcgctactaacttcagcctgctgaagcaggctggagacgtggaggagaaccctggacctggaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaaagcggccgccaccgcggtggagctcgaattaattcatcgatgatgatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctctagagtcggtgggcctcgggggcgggtgcggggtcggcggggccgccccgggtggcttcggtcggagccatggggtcgtgcgctcctttcggtcgggcgctgcgggtcgtggggcgggcgtcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccgggtcgacggtgtggcgcgtggcggggtagtcggcgaacgcggcggcgagggtgcgtacggcccgggggacgtcgtcgcgggtggcgaggcgcaccgtgggcttgtactcggtcatggaaggtcgtctccttgtgaggggtcaggggcgtgggtcaggggatggtggcggcaccggtcgtggcggccgacctgcaggcatgcaagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagaattcaagtgatctccaaaaaataagtactttttgactgtaaataaaattgtaaggagtaaaaagtacttttttttctaaaaaaatgtaattaagtaaaagtaaaagtattgatttttaattgtactcaagtaaagtaaaaatccccaaaaataatacttaagtacagtaatcaagtaaaattactcaagtactttacacctctggttcttgaccccctaccttcagcaagcccagcagatccgagctccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtg

SEQ ID NO: 42 - DNA, 2580 bp, Artificial Sequence
  Synthetic polynucleotide
atggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaatgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggtcctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccggcctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcg

SEQ ID NO: 43 - DNA, 389 bp, Artificial Sequence
  Synthetic polynucleotide
cccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggaggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcg

SEQ ID NO: 44 - DNA, 452 bp, Artificial Sequence
  Synthetic polynucleotide
cccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacaggacaaatctgacgaggaaaactgcgctgtggccacctgtcgccctgacgaattccagtgctctgatggaaactgcatccatg

SEQ ID NO: 45 - DNA, 450 bp, Artificial Sequence
  Synthetic polynucleotide
cccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgaggacaaatctgacgaggaaaactgcgctgtggccacctgtcgccctgacgaattccagtgctctgatggaaactgcatccatg

SEQ ID NO: 46 - DNA, 450 bp, Artificial Sequence
  Synthetic polynucleotide
cccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgacaaatctgacgaggaaaactgcgctgtggccacctgtcgccctgacgaattccagtgctctgatggaaactgcatccatg

SEQ ID NO: 47 - DNA, 127 bp, Artificial Sequence
  Synthetic polynucleotide
cttcatgtactggactgactggggaactcccgccaagatcaagaaagggggcctgaatggtgtggacatctactcgctggtgagctggtgactgaaaacattcagtggcccaatggcatcaccctag

SEQ ID NO: 48 - DNA, 2856 bp, Artificial Sequence
  Synthetic polynucleotide
atgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgt

SEQ ID NO: 49 - DNA, 2869 bp, Artificial Sequence
  Synthetic polynucleotide
atgggagtgaggcacccgccctgctcccaccggctcctggccgtctgcgccctcgtgtccttggcaaccgctgcactcctggggcacatcctactccatgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacccaggaacagtgcgaggcccgcggctgttgctacatccctgcaaagcaggggctgcagggagcccagatggggcagccctggtgcttcttcccacccagctaccccagctacaagctggagaacctgagctcctctgaaatgggctacacggccaccctgacccgtaccacccccaccttcttccccaaggacatcctgaccctgcggctggacgtgatgatggagactgagaaccgcctccacttcacgatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgctgaacacgacggtggcgcccctgttctttgcggaccagttccttcagctgtccacctcgctgccctcgcagtatatcacaggcctcgccgagcacctcagtcccctgatgctcagcaccagctggaccaggatcaccctgtggaaccgggaccttgcgcccacgcccggtgcgaacctctacgggtctcaccctttctacctggcgctggaggacggcgggtcggcacacggggtgttcctgctaaacagcaatgccatggatgtggtcctgcagccgagccctgcccttagctggaggtcgacaggtgggatcctggatgtctacatcttcctgggcccagagcccaagagcgtggtgcagcagtacctggacgttgtgggatacccgttcatgccgccatactggggcctgggcttccacctgtgccgctggggctactcctccaccgctatcacccgccaggtggtggagaacatgaccagggcccacttccccctggacgtccagtggaacgacctggactacatggactcccggagggacttcacgttcaacaaggatggcttccgggacttcccggccatggtgcaggagctgcaccagggcggccggcgctacatgatgatcgtggatcctgccatcagcagctcgggccctgccgggagctacaggccctacgacgagggtctgcggaggggggttttcatcaccaacgagaccggccagccgctgattgggaaggtatggcccgggtccactgccttccccgacttcaccaaccccacagccctggcctggtgggaggacatggtggctgagttccatgaccaggtgcccttcgacggcatgtggattgacatgaacgagccttccaacttcatcaggggctctgaggacggctgccccaacaatgagctggagaacccaccctacgtgcctggggtggttggggggaccctccaggcggccaccatctgtgcctccagccaccagtttctctccacacactacaacctgcacaacctctacggcctgaccgaagccatcgcctcccacagggcgctggtgaaggctcgggggacacgcccatttgtgatctcccgctcgacctttgctggccacggccgatacgccggccactggacgggggacgtgtggagctcctgggagcagctcgcctcctccgtgccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagtctgccccaggagccgtacagcttcagcgagccggcccagcaggccatgaggaaggccctcaccctgcgctacgcactcctcccccacctctacacactgttccaccaggcccacgtcgcgggggagaccgtggcccggcccctcttcctggagttccccaaggactctagcacctggactgtggaccaccagctcctgtggggggaggccctgctcatcaccccagtgctccaggccgggaaggccgaagtgactggctacttccccttgggcacatggtacgacctgcagacggtgccagtagaggcccttggcagcctcccacccccacctgcagctccccgtgagccagccatccacagcgaggggcagtgggtgacgctgccggcccccctggacaccatcaacgtccacctccgggctgggtacatcatccccctgcagggccctggcctcacaaccacagagtcccgccagcagcccatggccctggctgtggccctgaccaagggtggggaggcccgaggggagctgttctgggacgatggagagagcctggaagtgctggagcgaggggcctacacacaggtcatcttcctggccaggaataacacgatcgtgaatgagctggtacgtgtgaccagtgagggagctggcctgcagctgcagaaggtgactgcagaaggtgactgtcctgggcgtggccacggcgccccagcaggtcctctccaacggtgtccctgtctccaacttcacctacagccccgacaccaaggtcctggacatctgtgtctcgctgttgatgggagagcagtttctcgtcagctggtgt

SEQ ID NO: 50 - DNA, 2031 bp, Artificial Sequence
  Synthetic polynucleotide
atgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgta

SEQ ID NO: 51 - DNA, 2042 bp, Artificial Sequence
  Synthetic polynucleotide
atgccggggttcctggttcgcatcctccctctgttgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatggtgcatatatcaacgattttaagggtttggtttctaacctgactctcagttccaatatcctcacggactggacgatctttccactggacactgaggatgcagtgtgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgta

SEQ ID NO: 52 - DNA, 1365 bp, Artificial Sequence
  Synthetic polynucleotide
atggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggc

SEQ ID NO: 53 - DNA, 1378 bp, Artificial Sequence
  Synthetic polynucleotide
atggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggc

SEQ ID NO: 54 - DNA, 78 bp, Artificial Sequence
  Synthetic polynucleotide
aatgggaaaaagttaacaaaatgtacaaggaccgacaagggtaggtaacacatatatttttcttgatacttgcagaaa

SEQ ID NO: 55 - DNA, 78 bp, Artificial Sequence
  Synthetic polynucleotide
tttctgcaagtatcaagaaaaatatatgtgttacctacccttgtcggtccttgtacattttgttaactttttcccatt

SEQ ID NO: 56 - DNA, 39 bp, Artificial Sequence
  Synthetic polynucleotide
aatgggaaaaagttaacaaaatgtacaaggaccgacaag

SEQ ID NO: 57 - DNA, 34 bp, Artificial Sequence
  Synthetic polynucleotide
gtaacacatatatttttcttgatacttgcagaaa

SEQ ID NO: 58 - DNA, 39 bp, Artificial Sequence
  Synthetic polynucleotide
tttctgcaagtatcaagaaaaatatatgtgttacctacc

SEQ ID NO: 59 - DNA, 34 bp, Artificial Sequence
  Synthetic polynucleotide
cggtccttgtacattttgttaactttttcccatt

SEQ ID NO: 60 - DNA, 14 bp, Artificial Sequence
  Synthetic polynucleotide
acgtaccgtacggt

SEQ ID NO: 61 - DNA, 14 bp, Artificial Sequence
  Synthetic polynucleotide
accgtacggtacgt

SEQ ID NO: 62 - DNA, 14 bp, Artificial Sequence
  Synthetic polynucleotide
acgtaccgtacggt

SEQ ID NO: 63 - DNA, 13 bp, Artificial Sequence
  Synthetic polynucleotide
tggcatgcatgca

SEQ ID NO: 64 - DNA, 49 bp, Artificial Sequence
  Synthetic polynucleotide
ctggttctaatttctcatttgcaggaaatgctggcatagagcagcacta

SEQ ID NO: 65 - DNA, 10 bp, Artificial Sequence
  Synthetic polynucleotide
ggcttagatt

SEQ ID NO: 66 - DNA, 10 bp, Artificial Sequence
  Synthetic polynucleotide
attcgggtgt

SEQ ID NO: 67 - DNA, 11 bp, Artificial Sequence
  Synthetic polynucleotide
gggcttagatt

SEQ ID NO: 68 - DNA, 11 bp, Artificial Sequence
  Synthetic polynucleotide
gattcgggtgt

SEQ ID NO: 69 - DNA, 12 bp, Artificial Sequence
  Synthetic polynucleotide
tgggcttagatt

SEQ ID NO: 70 - DNA, 12 bp, Artificial Sequence
  Synthetic polynucleotide
agattcgggtgt

SEQ ID NO: 71 - DNA, 13 bp, Artificial Sequence
  Synthetic polynucleotide
gtgggcttagatt

SEQ ID NO: 72 - DNA, 13 bp, Artificial Sequence
  Synthetic polynucleotide
tagattcgggtgt

SEQ ID NO: 73 - DNA, 14 bp, Artificial Sequence
  Synthetic polynucleotide
ggtgggcttagatt

SEQ ID NO: 74 - DNA, 14 bp, Artificial Sequence
  Synthetic polynucleotide
ttagattcgggtgt

SEQ ID NO: 75 - DNA, 15 bp, Artificial Sequence
  Synthetic polynucleotide
aggtgggcttagatt

SEQ ID NO: 76 - DNA, 15 bp, Artificial Sequence
  Synthetic polynucleotide
tttagattcgggtgt

SEQ ID NO: 77 - DNA, 16 bp, Artificial Sequence
  Synthetic polynucleotide
taggtgggcttagatt

SEQ ID NO: 78 - DNA, 16 bp, Artificial Sequence
  Synthetic polynucleotide
ctttagattcgggtgt

SEQ ID NO: 79 - DNA, 17 bp, Artificial Sequence
  Synthetic polynucleotide
ttaggtgggcttagatt

SEQ ID NO: 80 - DNA, 17 bp, Artificial Sequence
  Synthetic polynucleotide
tctttagattcgggtgt

SEQ ID NO: 81 - DNA, 18 bp, Artificial Sequence
  Synthetic polynucleotide
attaggtgggcttagatt

SEQ ID NO: 82 - DNA, 18 bp, Artificial Sequence
  Synthetic polynucleotide
atctttagattcgggtgt

SEQ ID NO: 83 - DNA, 19 bp, Artificial Sequence
  Synthetic polynucleotide
aattaggtgggcttagatt

SEQ ID NO: 84 - DNA, 19 bp, Artificial Sequence
  Synthetic polynucleotide
catctttagattcgggtgt

SEQ ID NO: 85 - DNA, 20 bp, Artificial Sequence
  Synthetic polynucleotide
caattaggtgggcttagatt

SEQ ID NO: 86 - DNA, 20 bp, Artificial Sequence
  Synthetic polynucleotide
tcatctttagattcgggtgt

SEQ ID NO: 87 - DNA, 21 bp, Artificial Sequence
  Synthetic polynucleotide
acaattaggtgggcttagatt

SEQ ID NO: 88 - DNA, 21 bp, Artificial Sequence
  Synthetic polynucleotide
gtcatctttagattcgggtgt

SEQ ID NO: 89 - DNA, 22 bp, Artificial Sequence
  Synthetic polynucleotide
tacaattaggtgggcttagatt

SEQ ID NO: 90 - DNA, 22 bp, Artificial Sequence
  Synthetic polynucleotide
agtcatctttagattcgggtgt

SEQ ID NO: 91 - DNA, 23 bp, Artificial Sequence
  Synthetic polynucleotide
gtacaattaggtgggcttagatt

SEQ ID NO: 92 - DNA, 23 bp, Artificial Sequence
  Synthetic polynucleotide
cagtcatctttagattcgggtgt

SEQ ID NO: 93 - DNA, 24 bp, Artificial Sequence
  Synthetic polynucleotide
agtacaattaggtgggcttagatt

SEQ ID NO: 94 - DNA, 24 bp, Artificial Sequence
  Synthetic polynucleotide
tcagtcatctttagattcgggtgt

SEQ ID NO: 95 - DNA, 25 bp, Artificial Sequence
  Synthetic polynucleotide
cagtacaattaggtgggcttagatt

SEQ ID NO: 96 - DNA, 25 bp, Artificial Sequence
  Synthetic polynucleotide
atcagtcatctttagattcgggtgt

SEQ ID NO: 97 - DNA, 26 bp, Artificial Sequence
  Synthetic polynucleotide
tcagtacaattaggtgggcttagatt

SEQ ID NO: 98 - DNA, 26 bp, Artificial Sequence
  Synthetic polynucleotide
catcagtcatctttagattcgggtgt

SEQ ID NO: 99 - DNA, 20 bp, Artificial Sequence
  Synthetic polynucleotide
  misc_feature (1)..(1): n is a, c, g, or t
  misc_feature (20)..(20): n is a, c, g, or t
ntatcgggactatcgggacn

SEQ ID NO: 100 - DNA, 10 bp, Artificial Sequence
  Synthetic polynucleotide
  misc_feature (1)..(1): n is a, c, g, or t
ntatcgggac

SEQ ID NO: 101 - DNA, 10 bp, Artificial Sequence
  Synthetic polynucleotide
  misc_feature (10)..(10): n is a, c, g, or t
tatcgggacn

SEQ ID NO: 102 - DNA, 11 bp, Artificial Sequence
  Synthetic polynucleotide
  misc_feature (1)..(1): n is a, c, g, or t
  misc_feature (11)..(11): n is a, c, g, or t
ntatcgggacn

SEQ ID NO: 103 - DNA, 55 bp, Artificial Sequence
  Synthetic polynucleotide
  misc_feature (26)..(29): n is a, c, g, or t
gcccccacaaagcggaccagccagcnnnntagggaataaggccaacttgcacccc

SEQ ID NO: 104 - DNA, 55 bp, Artificial Sequence
  Synthetic polynucleotide
  misc_feature (26)..(29): n is a, c, g, or t
agtgcacgagtgacgggataatgtgnnnncaggtaattgataggcttccaactta

SEQ ID NO: 105 - DNA, 55 bp, Artificial Sequence
  Synthetic polynucleotide
  misc_feature (26)..(29): n is a, c, g, or t
ccgagacctacgcgaaccgaaatcgnnnnccggtgcgcaagcagggctggcgtcc

SEQ ID NO: 106 - DNA, 20 bp, Artificial Sequence
  Synthetic polynucleotide
ctcgctggtgagctggtgac

SEQ ID NO: 107 - DNA, 10 bp, Artificial Sequence
  Synthetic polynucleotide
ctcgctggtg

SEQ ID NO: 108 - DNA, 10 bp, Artificial Sequence
  Synthetic polynucleotide
agctggtgac

SEQ ID NO: 109 - DNA, 12 bp, Artificial Sequence
  Synthetic polynucleotide
ctcgctggtgac

SEQ ID NO: 110 - DNA, 11 bp, Artificial Sequence
  Synthetic polynucleotide
  misc_feature (1)..(2): n is a, c, g, or t
  misc_feature (10)..(11): n is a, c, g, or t
nngactggtnn

SEQ ID NO: 111 - DNA, 11 bp, Artificial Sequence
  Synthetic polynucleotide
  misc_feature (1)..(2): n is a, c, g, or t
  misc_feature (10)..(11): n is a, c, g, or t
nnaactggtnn

SEQ ID NO: 112 - DNA, 11 bp, Artificial Sequence
  Synthetic polynucleotide
  misc_feature (1)..(2): n is a, c, g, or t
  misc_feature (10)..(11): n is a, c, g, or t
nnacctggtnn

SEQ ID NO: 113 - DNA, 11 bp, Artificial Sequence
  Synthetic polynucleotide
  misc_feature (1)..(2): n is a, c, g, or t
  misc_feature (10)..(11): n is a, c, g, or t
nnaccgggtnn

SEQ ID NO: 114 - DNA, 11 bp, Artificial Sequence
  Synthetic polynucleotide
  misc_feature (1)..(2): n is a, c, g, or t
  misc_feature (10)..(11): n is a, c, g, or t
nnaccgagtnn

SEQ ID NO: 115 - DNA, 18 bp, Artificial Sequence
  Synthetic polynucleotide
  misc_feature (1)..(2): n is a, c, g, or t
  misc_feature (17)..(18): n is a, c, g, or t
nnaccgagtgactggtnn

SEQ ID NO: 116 - DNA, 14 bp, Artificial Sequence
  Synthetic polynucleotide
aggacaaatctgac

SEQ ID NO: 117 - DNA, 20 bp, Artificial Sequence
  Synthetic polynucleotide
ctttcactttatagatttat

SEQ ID NO: 118 - DNA, 20 bp, Artificial Sequence
  Synthetic polynucleotide
aatcctctaaatagttaaat

SEQ ID NO: 119 - DNA, 20 bp, Artificial Sequence
  Synthetic polynucleotide
aaatatctttaacctaaaac

SEQ ID NO: 120 - DNA, 20 bp, Artificial Sequence
  Synthetic polynucleotide
tgtcatctttatgcttaaag

SEQ ID NO: 121 - DNA, 20 bp, Artificial Sequence
  Synthetic polynucleotide
tttaagcacagcaaggctct

SEQ ID NO: 122 - DNA, 20 bp, Artificial Sequence
  Synthetic polynucleotide
tcttatcttgcaaggcttca

SEQ ID NO: 123 - DNA, 20 bp, Artificial Sequence
  Synthetic polynucleotide
tccgctctacaatatgtatg

SEQ ID NO: 124 - DNA, 20 bp, Artificial Sequence
  Synthetic polynucleotide
acctcccatactggtacttc

SEQ ID NO: 125 - DNA, 20 bp, Artificial Sequence
  Synthetic polynucleotide
aacaatcctgcatacgaata

SEQ ID NO: 126 - DNA, 20 bp, Artificial Sequence
  Synthetic polynucleotide
accatccgttaatgtagcgt

SEQ ID NO: 127 - DNA, 20 bp, Artificial Sequence
  Synthetic polynucleotide
ttaatacatgtaagtctgtc

SEQ ID NO: 128 - DNA, 20 bp, Artificial Sequence
  Synthetic polynucleotide
aaaagactacggttctgatc

SEQ ID NO: 129 - DNA, 20 bp, Artificial Sequence
  Synthetic polynucleotide
tgtgctcgaagctagcaagc

SEQ ID NO: 130 - DNA, 20 bp, Artificial Sequence
  Synthetic polynucleotide
aactttcaatccttcaccac

SEQ ID NO: 131 - DNA, 20 bp, Artificial Sequence
  Synthetic polynucleotide
acatcaccaaatagatgcga

SEQ ID NO: 132 - DNA, 20 bp, Artificial Sequence
  Synthetic polynucleotide
acatatcaccttggtaaaat

SEQ ID NO: 133 - DNA, 20 bp, Artificial Sequence
  Synthetic polynucleotide
tactctcaacatggtaaaat

SEQ ID NO: 134 - DNA, 20 bp, Artificial Sequence
  Synthetic polynucleotide
tctggcctccttcaggattt

SEQ ID NO: 135 - DNA, 20 bp, Artificial Sequence
  Synthetic polynucleotide
atagaactttattccttcct

SEQ ID NO: 136 - DNA, 20 bp, Artificial Sequence
  Synthetic polynucleotide
acattacttatattacttac

SEQ ID NO: 137 - DNA, 20 bp, Artificial Sequence
  Synthetic polynucleotide
tactgtccatagccttatag

SEQ ID NO: 138 - DNA, 20 bp, Artificial Sequence
  Synthetic polynucleotide
aggatgcacgaacttggatt

SEQ ID NO: 139 - DNA, 20 bp, Artificial Sequence
  Synthetic polynucleotide
aaaatactcaacgtagatgt

SEQ ID NO: 140 - DNA, 20 bp, Artificial Sequence
  Synthetic polynucleotide
gtacttctatcctaaattcc

SEQ ID NO: 141 - DNA, 20 bp, Artificial Sequence
  Synthetic polynucleotide
ttcccacttaggaacgcatt

SEQ ID NO: 142 - DNA, 20 bp, Artificial Sequence
  Synthetic polynucleotide
tgatttcattatttgacaga

SEQ ID NO: 143 - DNA, 20 bp, Artificial Sequence
  Synthetic polynucleotide
actgcaccagtatgacagta

SEQ ID NO: 144 - DNA, 20 bp, Artificial Sequence
  Synthetic polynucleotide
taataactagaagcagacag

SEQ ID NO: 145 - DNA, 20 bp, Artificial Sequence
  Synthetic polynucleotide
tatattctcgtctaatacgt

SEQ ID NO: 146 - DNA, 20 bp, Artificial Sequence
  Synthetic polynucleotide
acatagctttatgtccatgt

SEQ ID NO: 147 - DNA, 20 bp, Artificial Sequence
  Synthetic polynucleotide
acgatgcgcgaaggttattc

SEQ ID NO: 148 - DNA, 20 bp, Artificial Sequence
  Synthetic polynucleotide
atttatcgctaacggatttc

SEQ ID NO: 149 - DNA, 20 bp, Artificial Sequence
  Synthetic polynucleotide
aaagcacaattcggataatt

SEQ ID NO: 150 - DNA, 20 bp, Artificial Sequence
  Synthetic polynucleotide
accaggcaaagacactctct

SEQ ID NO: 151 - DNA, 20 bp, Artificial Sequence
  Synthetic polynucleotide
aaaccacataaggaaatttg

SEQ ID NO: 152 - DNA, 20 bp, Artificial Sequence
  Synthetic polynucleotide
cacttcctagtggcaataat

SEQ ID NO: 153 - DNA, 20 bp, Artificial Sequence
  Synthetic polynucleotide
cccagtcaaggtttattcaa

SEQ ID NO: 154 - DNA, 20 bp, Artificial Sequence
  Synthetic polynucleotide
caaacccgctgtctagctct

SEQ ID NO: 155 - DNA, 20 bp, Artificial Sequence
  Synthetic polynucleotide
ccctaacagtgctcttcgtg

SEQ ID NO: 156 - DNA, 20 bp, Artificial Sequence
  Synthetic polynucleotide
ttaacccctgagattggaat

SEQ ID NO: 157 - DNA, 20 bp, Artificial Sequence
  Synthetic polynucleotide
aaacatcgaataacgcgtag

SEQ ID NO: 158 - DNA, 20 bp, Artificial Sequence
  Synthetic polynucleotide
atatcccaccgtggttcaga

SEQ ID NO: 159 - DNA, 20 bp, Artificial Sequence
  Synthetic polynucleotide
cctcaactatacatccgtgc

SEQ ID NO: 160 - DNA, 20 bp, Artificial Sequence
  Synthetic polynucleotide
cagattcaacacaagcctgc

SEQ ID NO: 161 - DNA, 20 bp, Artificial Sequence
  Synthetic polynucleotide
ttatatcatcagatcaccac

SEQ ID NO: 162 - DNA, 20 bp, Artificial Sequence
  Synthetic polynucleotide
caccgtccgcgcggttaata

SEQ ID NO: 163 - DNA, 20 bp, Artificial Sequence
  Synthetic polynucleotide
actatgcatctggcctttaa

SEQ ID NO: 164 - DNA, 20 bp, Artificial Sequence
  Synthetic polynucleotide
ccgacccctcagctatttca

SEQ ID NO: 165 - DNA, 20 bp, Artificial Sequence
  Synthetic polynucleotide
tccccaccatccatggttat

SEQ ID NO: 166 - DNA, 20 bp, Artificial Sequence
  Synthetic polynucleotide
agtcttcgtctcagctagct

SEQ ID NO: 167 - DNA, 20 bp, Artificial Sequence
  Synthetic polynucleotide
acgtcgctttcagaatttca

SEQ ID NO: 168 - DNA, 20 bp, Artificial Sequence
  Synthetic polynucleotide
aatcttcccctgtttcctcc

SEQ ID NO: 169 - DNA, 20 bp, Artificial Sequence
  Synthetic polynucleotide
actacgcccaaaccggctat

SEQ ID NO: 170 - DNA, 20 bp, Artificial Sequence
  Synthetic polynucleotide
gataagcgattatggaatca

SEQ ID NO: 171 - DNA, 20 bp, Artificial Sequence
  Synthetic polynucleotide
aaacctctttcatacacgca

SEQ ID NO: 172 - DNA, 20 bp, Artificial Sequence
  Synthetic polynucleotide
tgtccgcctactcaacacaa

SEQ ID NO: 173 - DNA, 20 bp, Artificial Sequence
  Synthetic polynucleotide
agacatctgtgtacatacat

SEQ ID NO: 174 - DNA, 20 bp, Artificial Sequence
  Synthetic polynucleotide
aaaagtcctcctttcaccac

SEQ ID NO: 175 - DNA, 20 bp, Artificial Sequence
  Synthetic polynucleotide
ccatcactcctaaagacgac

SEQ ID NO: 176 - DNA, 20 bp, Artificial Sequence
  Synthetic polynucleotide
atcacccgaagtcctaccga

SEQ ID NO: 177 - DNA, 20 bp, Artificial Sequence
  Synthetic polynucleotide
gaccagcccacacggaaatt

SEQ ID NO: 178 - DNA, 20 bp, Artificial Sequence
  Synthetic polynucleotide
gaatccccctgattctcgct

SEQ ID NO: 179 - DNA, 20 bp, Artificial Sequence
  Synthetic polynucleotide
gtagcactatctctgtctct

SEQ ID NO: 180 - DNA, 20 bp, Artificial Sequence
  Synthetic polynucleotide
tcctatctccgaaccctgaa

SEQ ID NO: 181 - DNA, 20 bp, Artificial Sequence
  Synthetic polynucleotide
cctctgcagtaatttactta

SEQ ID NO: 182 - DNA, 20 bp, Artificial Sequence
  Synthetic polynucleotide
cttctaccttccagtcagtc

SEQ ID NO: 183 - DNA, 20 bp, Artificial Sequence
  Synthetic polynucleotide
tgccttcctcttccacacac

SEQ ID NO: 184 - DNA, 20 bp, Artificial Sequence
  Synthetic polynucleotide
atccttctcaaaagacagac

SEQ ID NO: 185 - DNA, 20 bp, Artificial Sequence
  Synthetic polynucleotide
acgtccccactcgatgaaga

SEQ ID NO: 186 - DNA, 20 bp, Artificial Sequence
  Synthetic polynucleotide
ttaagccacttaatcaccac

SEQ ID NO: 187 - DNA, 20 bp, Artificial Sequence
  Synthetic polynucleotide
cacagtcgagcaattaccga

SEQ ID NO: 188 - DNA, 20 bp, Artificial Sequence
  Synthetic polynucleotide
cacactcccatcgatcccga

SEQ ID NO: 189 - DNA, 20 bp, Artificial Sequence
  Synthetic polynucleotide
aatactctgcgtgagtttag

SEQ ID NO: 190 - DNA, 20 bp, Artificial Sequence
  Synthetic polynucleotide
acataacactccaatttaat

SEQ ID NO: 191 - DNA, 20 bp, Artificial Sequence
  Synthetic polynucleotide
tcaggtcactgctaataaat

SEQ ID NO: 192 - DNA, 20 bp, Artificial Sequence
  Synthetic polynucleotide
ttcaaaccaaaagtaattaa

SEQ ID NO: 193 - DNA, 20 bp, Artificial Sequence
  Synthetic polynucleotide
aaatttcagagaactactat

SEQ ID NO: 194 - DNA, 20 bp, Artificial Sequence
  Synthetic polynucleotide
ataaaactgcgcttggaata

SEQ ID NO: 195 - DNA, 20 bp, Artificial Sequence
  Synthetic polynucleotide
tttcttctagaaggtcaaaa

SEQ ID NO: 196 - DNA, 20 bp, Artificial Sequence
  Synthetic polynucleotide
ttaatacctttactaagaag

SEQ ID NO: 197 - DNA, 20 bp, Artificial Sequence
  Synthetic polynucleotide
atatatcaaactagaaatgt

SEQ ID NO: 198 - DNA, 20 bp, Artificial Sequence
  Synthetic polynucleotide
tagattccctatattgcaat

SEQ ID NO: 199 - DNA, 20 bp, Artificial Sequence
  Synthetic polynucleotide
ttaaatccaaccctatgatg

SEQ ID NO: 200 - DNA, 20 bp, Artificial Sequence
  Synthetic polynucleotide
cctcgtctgaaattcgaaat

SEQ ID NO: 201 - DNA, 20 bp, Artificial Sequence
  Synthetic polynucleotide
aattgtcactttaacccagc

SEQ ID NO: 202 - DNA, 20 bp, Artificial Sequence
  Synthetic polynucleotide
agtatccatatcaagaacga

SEQ ID NO: 203 - DNA, 20 bp, Artificial Sequence
  Synthetic polynucleotide
tacctccaggtattcacggt

SEQ ID NO: 204 - DNA, 20 bp, Artificial Sequence
  Synthetic polynucleotide
ttcaatcttagccctaatta

SEQ ID NO: 205 - DNA, 20 bp, Artificial Sequence
  Synthetic polynucleotide
ccacaaccaataatttattt

SEQ ID NO: 206 - DNA, 20 bp, Artificial Sequence
  Synthetic polynucleotide
ttataacgtttgcttattta

SEQ ID NO: 207 - DNA, 20 bp, Artificial Sequence
  Synthetic polynucleotide
tagcaactggctttcaaaca

SEQ ID NO: 208 - DNA, 20 bp, Artificial Sequence
  Synthetic polynucleotide
tccgacccataggttatata

SEQ ID NO: 209 - DNA, 20 bp, Artificial Sequence
  Synthetic polynucleotide
tccactcgatatggtagttt

SEQ ID NO: 210 - DNA, 20 bp, Artificial Sequence
  Synthetic polynucleotide
aacaacctgtggcaggtata

SEQ ID NO: 211 - DNA, 20 bp, Artificial Sequence
  Synthetic polynucleotide
tcgacaccttaatataacct

SEQ ID NO: 212 - DNA, 20 bp, Artificial Sequence
  Synthetic polynucleotide
aaaaggctattaagggtatc

SEQ ID NO: 213 - DNA, 20 bp, Artificial Sequence
  Synthetic polynucleotide
tcacatcacatccaactaac

SEQ ID NO: 214 - DNA, 20 bp, Artificial Sequence
  Synthetic polynucleotide
ctataacttatagtaccagt

SEQ ID NO: 215 - DNA, 20 bp, Artificial Sequence
  Synthetic polynucleotide
caccaactcaatttgacgtt

SEQ ID NO: 216 - DNA, 20 bp, Artificial Sequence
  Synthetic polynucleotide
cgatctctgaataacacctg

SEQ ID NO: 217 - DNA, 20 bp, Artificial Sequence
  Synthetic polynucleotide
ttacgcccctacgaacgaga

SEQ ID NO: 218 - DNA, 20 bp, Artificial Sequence
  Synthetic polynucleotide
ctgacacgacacttgataga

SEQ ID NO: 219 - DNA, 20 bp, Artificial Sequence
  Synthetic polynucleotide
tgtatacatcaactctttct

SEQ ID NO: 220 - DNA, 20 bp, Artificial Sequence
  Synthetic polynucleotide
gccgtacactgttatttatt

SEQ ID NO: 221 - DNA, 20 bp, Artificial Sequence
  Synthetic polynucleotide
aaagagcacttccattaatt

SEQ ID NO: 222 - DNA, 20 bp, Artificial Sequence
  Synthetic polynucleotide
tgtatacacataaattcttt

SEQ ID NO: 223 - DNA, 20 bp, Artificial Sequence
  Synthetic polynucleotide
tctcaccaaatccatatata

SEQ ID NO: 224 - DNA, 20 bp, Artificial Sequence
  Synthetic polynucleotide
cgtccacactcgggcaattg

SEQ ID NO: 225 - DNA, 20 bp, Artificial Sequence
  Synthetic polynucleotide
gtccctctagcatcgggata

SEQ ID NO: 226 - DNA, 20 bp, Artificial Sequence
  Synthetic polynucleotide
aatatgcattatctacggct

SEQ ID NO: 227 - DNA, 20 bp, Artificial Sequence
  Synthetic polynucleotide
ccgactcgaatgggccaaat

SEQ ID NO: 228 - DNA, 20 bp, Artificial Sequence
  Synthetic polynucleotide
atacttccaggtttatagcg

SEQ ID NO: 229 - DNA, 20 bp, Artificial Sequence
  Synthetic polynucleotide
caccacctatttctaacgct

SEQ ID NO: 230 - DNA, 20 bp, Artificial Sequence
  Synthetic polynucleotide
ccatcccttaacatatgaac

SEQ ID NO: 231 - DNA, 20 bp, Artificial Sequence
  Synthetic polynucleotide
agcatccatcaaacatgaga

SEQ ID NO: 232 - DNA, 20 bp, Artificial Sequence
  Synthetic polynucleotide
acgctacttaggcacctaga

SEQ ID NO: 233 - DNA, 20 bp, Artificial Sequence
  Synthetic polynucleotide
tatgcgcctgacataacgac

SEQ ID NO: 234 - DNA, 20 bp, Artificial Sequence
  Synthetic polynucleotide
agtcaactgatttcctttcc

SEQ ID NO: 235 - DNA, 20 bp, Artificial Sequence
  Synthetic polynucleotide
gctcctcttgggtctttaat

SEQ ID NO: 236 - DNA, 20 bp, Artificial Sequence
  Synthetic polynucleotide
aatcagcgcctgcattaatt

SEQ ID NO: 237 - DNA, 20 bp, Artificial Sequence
  Synthetic polynucleotide
caacaacacctattgtaaat

SEQ ID NO: 238 - DNA, 20 bp, Artificial Sequence
  Synthetic polynucleotide
gtaaagcttaaccatttacc

SEQ ID NO: 239 - DNA, 20 bp, Artificial Sequence
  Synthetic polynucleotide
actcgtcatcttattgtttg

SEQ ID NO: 240 - DNA, 20 bp, Artificial Sequence
  Synthetic polynucleotide
attccgccacacaatcaatc

SEQ ID NO: 241 - DNA, 20 bp, Artificial Sequence
  Synthetic polynucleotide
ttcacaccgtcaactgttgc

SEQ ID NO: 242 - DNA, 20 bp, Artificial Sequence
  Synthetic polynucleotide
tgttgccctgataattctcc

SEQ ID NO: 243 - DNA, 20 bp, Artificial Sequence
  Synthetic polynucleotide
tacctgcatcccctgctagc

SEQ ID NO: 244 - DNA, 20 bp, Artificial Sequence
  Synthetic polynucleotide
aatacccaaaattccgaaag

SEQ ID NO: 245 - DNA, 20 bp, Artificial Sequence
  Synthetic polynucleotide
cgtccccgtattacctgggc

SEQ ID NO: 246 - DNA, 20 bp, Artificial Sequence
  Synthetic polynucleotide
taacaacaagaagttatcga

SEQ ID NO: 247 - DNA, 20 bp, Artificial Sequence
  Synthetic polynucleotide
agatgccgtctaacccgaac

SEQ ID NO: 248 - DNA, 20 bp, Artificial Sequence
  Synthetic polynucleotide
cttaagccgtataattacgt

SEQ ID NO: 249 - DNA, 20 bp, Artificial Sequence
  Synthetic polynucleotide
accccactattagtctatct

SEQ ID NO: 250 - DNA, 20 bp, Artificial Sequence
  Synthetic polynucleotide
cctccgcagcttagctattt

SEQ ID NO: 251 - DNA, 20 bp, Artificial Sequence
  Synthetic polynucleotide
aacccccacccgccttgttt

SEQ ID NO: 252 - DNA, 20 bp, Artificial Sequence
  Synthetic polynucleotide
cgcctacgacccctttattt

SEQ ID NO: 253 - DNA, 20 bp, Artificial Sequence
  Synthetic polynucleotide
acttcgccatgtcctcaatg

SEQ ID NO: 254 - DNA, 20 bp, Artificial Sequence
  Synthetic polynucleotide
cgctatcccccagcgccaca

SEQ ID NO: 255 - DNA, 20 bp, Artificial Sequence
  Synthetic polynucleotide
gtgcgccaagtacatcaatc

SEQ ID NO: 256 - DNA, 20 bp, Artificial Sequence
  Synthetic polynucleotide
tcccttcatctctgtatgta

SEQ ID NO: 257 - DNA, 20 bp, Artificial Sequence
  Synthetic polynucleotide
tgcacgccccacctaaaaaa

SEQ ID NO: 258 - DNA, 20 bp, Artificial Sequence
  Synthetic polynucleotide
atcgtccccagacacgcgat

SEQ ID NO: 259 - DNA, 20 bp, Artificial Sequence
  Synthetic polynucleotide
tctctacccatgaactaagg

SEQ ID NO: 260 - DNA, 20 bp, Artificial Sequence
  Synthetic polynucleotide
cctctcctaagccccccaag

SEQ ID NO: 261 - DNA, 20 bp, Artificial Sequence
  Synthetic polynucleotide
ctcacacgagtatccccagt

SEQ ID NO: 262 - DNA, 20 bp, Artificial Sequence
  Synthetic polynucleotide
ccgtctcctgcaatctcagc

SEQ ID NO: 263 - DNA, 20 bp, Artificial Sequence
  Synthetic polynucleotide
tacacacaattctacgaggt

SEQ ID NO: 264 - DNA, 20 bp, Artificial Sequence
  Synthetic polynucleotide
aattgcccattcattaatta

SEQ ID NO: 265 - DNA, 20 bp, Artificial Sequence
  Synthetic polynucleotide
agtaaaccttcaactattta

SEQ ID NO: 266 - DNA, 20 bp, Artificial Sequence
  Synthetic polynucleotide
aaattacttcgaaaattatt

SEQ ID NO: 267 - DNA, 20 bp, Artificial Sequence
  Synthetic polynucleotide
aaacaactagtagtttgttt

SEQ ID NO: 268 - DNA, 20 bp, Artificial Sequence
  Synthetic polynucleotide
tactatcacaacattgattt

SEQ ID NO: 269 - DNA, 20 bp, Artificial Sequence
  Synthetic polynucleotide
tgagcactaagtatattgca

SEQ ID NO: 270 - DNA, 20 bp, Artificial Sequence
  Synthetic polynucleotide
aaatagctagatgatggtcg

SEQ ID NO: 271 - DNA, 20 bp, Artificial Sequence
  Synthetic polynucleotide
ttctaactcggaactaagaa

SEQ ID NO: 272 - DNA, 20 bp, Artificial Sequence
  Synthetic polynucleotide
taaattcaaaaaatgtttgc

SEQ ID NO: 273 - DNA, 20 bp, Artificial Sequence
  Synthetic polynucleotide
caacatctcacttaaccctt

SEQ ID NO: 274 - DNA, 20 bp, Artificial Sequence
  Synthetic polynucleotide
taatgtcctatagcgcacaa

SEQ ID NO: 275 - DNA, 20 bp, Artificial Sequence
  Synthetic polynucleotide
taagaccatcttctctggtg

SEQ ID NO: 276 - DNA, 20 bp, Artificial Sequence
  Synthetic polynucleotide
aatacgcattaatgtagcga

SEQ ID NO: 277 - DNA, 20 bp, Artificial Sequence
  Synthetic polynucleotide
agtaaactctttagcaacgc

SEQ ID NO: 278 - DNA, 20 bp, Artificial Sequence
  Synthetic polynucleotide
tatatccctacatacaacag

SEQ ID NO: 279 - DNA, 20 bp, Artificial Sequence
  Synthetic polynucleotide
cctccccatttaattattat

SEQ ID NO: 280 - DNA, 20 bp, Artificial Sequence
  Synthetic polynucleotide
gcttaacaagacttctttca

SEQ ID NO: 281 - DNA, 20 bp, Artificial Sequence
  Synthetic polynucleotide
tgtccccaaaaaattaatta

SEQ ID NO: 282 - DNA, 20 bp, Artificial Sequence
  Synthetic polynucleotide
catccccccctgatgattta

SEQ ID NO: 283 - DNA, 20 bp, Artificial Sequence
  Synthetic polynucleotide
tacaatcgagtaataattat

SEQ ID NO: 284 - DNA, 20 bp, Artificial Sequence
  Synthetic polynucleotide
acccctcatatagatataag

SEQ ID NO: 285 - DNA, 20 bp, Artificial Sequence
  Synthetic polynucleotide
gacaaaccacctgtcggtat

SEQ ID NO: 286 - DNA, 20 bp, Artificial Sequence
  Synthetic polynucleotide
tggataccgacatgcaatta

SEQ ID NO: 287 - DNA, 20 bp, Artificial Sequence
  Synthetic polynucleotide
aatgaccaatatagatctag

SEQ ID NO: 288 - DNA, 20 bp, Artificial Sequence
  Synthetic polynucleotide
aattgcccaaacttcacttc

SEQ ID NO: 289 - DNA, 20 bp, Artificial Sequence
  Synthetic polynucleotide
tcctttcatcccaatagaga

SEQ ID NO: 290 - DNA, 20 bp, Artificial Sequence
  Synthetic polynucleotide
ttgcacccatatcatacatc

SEQ ID NO: 291 - DNA, 20 bp, Artificial Sequence
  Synthetic polynucleotide
atttcacgatatatcaaggc

SEQ ID NO: 292 - DNA, 20 bp, Artificial Sequence
  Synthetic polynucleotide
atcgaacattaaattacgga

SEQ ID NO: 293 - DNA, 20 bp, Artificial Sequence
  Synthetic polynucleotide
cacttactatacgaaccgaa

SEQ ID NO: 294 - DNA, 20 bp, Artificial Sequence
  Synthetic polynucleotide
gcccaactgctagattaaat

SEQ ID NO: 295 - DNA, 20 bp, Artificial Sequence
  Synthetic polynucleotide
atgcttccttcctattatta

SEQ ID NO: 296 - DNA, 20 bp, Artificial Sequence
  Synthetic polynucleotide
cctgtacataaaggatattt

SEQ ID NO: 297 - DNA, 20 bp, Artificial Sequence
  Synthetic polynucleotide
ataaagctctgtcgttaata

SEQ ID NO: 298 - DNA, 20 bp, Artificial Sequence
  Synthetic polynucleotide
cccgtacagccctaaataaa

SEQ ID NO: 299 - DNA, 20 bp, Artificial Sequence
  Synthetic polynucleotide
ctctgtcatagtttgttaaa

SEQ ID NO: 300 - DNA, 20 bp, Artificial Sequence
  Synthetic polynucleotide
cccaccccacaagtgtaagt

SEQ ID NO: 301 - DNA, 20 bp, Artificial Sequence
  Synthetic polynucleotide
gcaaagcacgtaaggtccat

SEQ ID NO: 302 - DNA, 20 bp, Artificial Sequence
  Synthetic polynucleotide
tcttcccgtatcttagaacc

SEQ ID NO: 303 - DNA, 20 bp, Artificial Sequence
  Synthetic polynucleotide
aatctacacatttaagcgtg

SEQ ID NO: 304 - DNA, 20 bp, Artificial Sequence
  Synthetic polynucleotide
gcataccaaccctttaagta

SEQ ID NO: 305 - DNA, 20 bp, Artificial Sequence
  Synthetic polynucleotide
tggtcacttcagtatatagc

SEQ ID NO: 306 - DNA, 20 bp, Artificial Sequence
  Synthetic polynucleotide
catgatcaagtcaaccatgt

SEQ ID NO: 307 - DNA, 20 bp, Artificial Sequence
  Synthetic polynucleotide
taagcacagaattccaggaa

SEQ ID NO: 308 - DNA, 20 bp, Artificial Sequence
  Synthetic polynucleotide
cgtcacctcgatcgtcgaga

SEQ ID NO: 309 - DNA, 20 bp, Artificial Sequence
  Synthetic polynucleotide
accccccttagggggtttat

SEQ ID NO: 310 - DNA, 20 bp, Artificial Sequence
  Synthetic polynucleotide
catatacagcaagcatattg

SEQ ID NO: 311 - DNA, 20 bp, Artificial Sequence
  Synthetic polynucleotide
gcctttcaccagatatttag

SEQ ID NO: 312 - DNA, 20 bp, Artificial Sequence
  Synthetic polynucleotide
tggcatcccgccttatagat

SEQ ID NO: 313 - DNA, 20 bp, Artificial Sequence
  Synthetic polynucleotide
ccccgcctacatacctaact

SEQ ID NO: 314 - DNA, 20 bp, Artificial Sequence
  Synthetic polynucleotide
aagatccctcaccttctctt

SEQ ID NO: 315 - DNA, 20 bp, Artificial Sequence
  Synthetic polynucleotide
aaaacccggataccaaatcg

SEQ ID NO: 316 - DNA, 20 bp, Artificial Sequence
  Synthetic polynucleotide
gcgtctccatattagtttag

SEQ ID NO: 317 - DNA, 20 bp, Artificial Sequence
  Synthetic polynucleotide
attccacccccggacatctg

SEQ ID NO: 318 - DNA, 20 bp, Artificial Sequence
  Synthetic polynucleotide
gagctgccatcctagcagta

SEQ ID NO: 319 - DNA, 20 bp, Artificial Sequence
  Synthetic polynucleotide
gtaacaccataaatactatg

SEQ ID NO: 320 - DNA, 20 bp, Artificial Sequence
  Synthetic polynucleotide
ccaaaactcatccataccct

SEQ ID NO: 321 - DNA, 20 bp, Artificial Sequence
  Synthetic polynucleotide
aggtcaccataaatcatggg

SEQ ID NO: 322 - DNA, 20 bp, Artificial Sequence
  Synthetic polynucleotide
gaatgccaaggtaaaaaggt

SEQ ID NO: 323 - DNA, 20 bp, Artificial Sequence
  Synthetic polynucleotide
cgtagaccagtgacaccgtg

SEQ ID NO: 324 - DNA, 20 bp, Artificial Sequence
  Synthetic polynucleotide
tccactcgtcaaaaatttca

SEQ ID NO: 325 - DNA, 20 bp, Artificial Sequence
  Synthetic polynucleotide
tcctctcggccggaatcttt

SEQ ID NO: 326 - DNA, 20 bp, Artificial Sequence
  Synthetic polynucleotide
gctactctcccctcttaatt

SEQ ID NO: 327 - DNA, 20 bp, Artificial Sequence
  Synthetic polynucleotide
tgatctctcctctcttccta

SEQ ID NO: 328 - DNA, 20 bp, Artificial Sequence
  Synthetic polynucleotide
caccgcccatccgtacttag

SEQ ID NO: 329 - DNA, 20 bp, Artificial Sequence
  Synthetic polynucleotide
cccattccgcaactactgcg

SEQ ID NO: 330 - DNA, 20 bp, Artificial Sequence
  Synthetic polynucleotide
cacccgcacctacaaaggtt

SEQ ID NO: 331 - DNA, 20 bp, Artificial Sequence
  Synthetic polynucleotide
ccgaccccgaagccctcgca

SEQ ID NO: 332 - DNA, 20 bp, Artificial Sequence
  Synthetic polynucleotide
actccaccctctcggcctga

SEQ ID NO: 333 - DNA, 20 bp, Artificial Sequence
  Synthetic polynucleotide
tttctccccccatgccatga

SEQ ID NO: 334 - DNA, 20 bp, Artificial Sequence
  Synthetic polynucleotide
atatgcctacgtaacaagcg

SEQ ID NO: 335 - DNA, 20 bp, Artificial Sequence
  Synthetic polynucleotide
cctacactattcacgtctgg

SEQ ID NO: 336 - DNA, 20 bp, Artificial Sequence
  Synthetic polynucleotide
cagcatcgtatcacaaccgt

SEQ ID NO: 337 - DNA, 20 bp, Artificial Sequence
  Synthetic polynucleotide
aaccaacagacacctacggg

SEQ ID NO: 338 - DNA, 20 bp, Artificial Sequence
  Synthetic polynucleotide
gcatctcactcgactaacgg

SEQ ID NO: 339 - DNA, 20 bp, Artificial Sequence
  Synthetic polynucleotide
ttactcctgtgtgatttaaa

SEQ ID NO: 340 - DNA, 20 bp, Artificial Sequence
  Synthetic polynucleotide
caatatctgcctatttattg

SEQ ID NO: 341 - DNA, 20 bp, Artificial Sequence
  Synthetic polynucleotide
aaacttcaaccaatataaat

SEQ ID NO: 342 - DNA, 20 bp, Artificial Sequence
  Synthetic polynucleotide
caatatcctgtaatataatc

SEQ ID NO: 343 - DNA, 20 bp, Artificial Sequence
  Synthetic polynucleotide
aagcaacaaaatttgaattt

SEQ ID NO: 344 - DNA, 20 bp, Artificial Sequence
  Synthetic polynucleotide
acaattcacccctcgattca

SEQ ID NO: 345 - DNA, 20 bp, Artificial Sequence
  Synthetic polynucleotide
atcaaacgtcaagaatgtct

SEQ ID NO: 346 - DNA, 20 bp, Artificial Sequence
  Synthetic polynucleotide
tttgcacaaaagttagtaaa

SEQ ID NO: 347 - DNA, 20 bp, Artificial Sequence
  Synthetic polynucleotide
tctctaccattacattcata

SEQ ID NO: 348 - DNA, 20 bp, Artificial Sequence
  Synthetic polynucleotide
taatagcttgggttgtacca

SEQ ID NO: 349 - DNA, 20 bp, Artificial Sequence
  Synthetic polynucleotide
cgtaatctcgtatttctgac

SEQ ID NO: 350 - DNA, 20 bp, Artificial Sequence
  Synthetic polynucleotide
tcagtacaaatgagagtatc

SEQ ID NO: 351 - DNA, 20 bp, Artificial Sequence
  Synthetic polynucleotide
tgaacacattaatatgacac

SEQ ID NO: 352 - DNA, 20 bp, Artificial Sequence
  Synthetic polynucleotide
atttcacaatctggcaacga

SEQ ID NO: 353 - DNA, 20 bp, Artificial Sequence
  Synthetic polynucleotide
cgattacattaatagacggc

SEQ ID NO: 354 - DNA, 20 bp, Artificial Sequence
  Synthetic polynucleotide
cctctacaacagacttattg

SEQ ID NO: 355 - DNA, 20 bp, Artificial Sequence
  Synthetic polynucleotide
agcgccctatgggcataatt

SEQ ID NO: 356 - DNA, 20 bp, Artificial Sequence
  Synthetic polynucleotide
cataatcatttctaatttaa

SEQ ID NO: 357 - DNA, 20 bp, Artificial Sequence
  Synthetic polynucleotide
tcacgaccattcctgattag

SEQ ID NO: 358 - DNA, 20 bp, Artificial Sequence
  Synthetic polynucleotide
atgtaactttggttgtttac

SEQ ID NO: 359 - DNA, 20 bp, Artificial Sequence
  Synthetic polynucleotide
gggtctcgatcattattata

SEQ ID NO: 360 - DNA, 20 bp, Artificial Sequence
  Synthetic polynucleotide
tcctatcctccgatcgcctt

SEQ ID NO: 361 - DNA, 20 bp, Artificial Sequence
  Synthetic polynucleotide
gttataccggttatacaatg

SEQ ID NO: 362 - DNA, 20 bp, Artificial Sequence
  Synthetic polynucleotide
atattcccagtataattaca

SEQ ID NO: 363 - DNA, 20 bp, Artificial Sequence
  Synthetic polynucleotide
ccaattctaagagaaacctc

SEQ ID NO: 364 - DNA, 20 bp, Artificial Sequence
  Synthetic polynucleotide
ttcattccaacgtattaagg

SEQ ID NO: 365 - DNA, 20 bp, Artificial Sequence
  Synthetic polynucleotide
taagatcaaaattaatgacc

SEQ ID NO: 366 - DNA, 20 bp, Artificial Sequence
  Synthetic polynucleotide
caggtacttgtacaaccgtg

SEQ ID NO: 367 - DNA, 20 bp, Artificial Sequence
  Synthetic polynucleotide
tagaaacttcctaaaaacgc

SEQ ID NO: 368 - DNA, 20 bp, Artificial Sequence
  Synthetic polynucleotide
tacactctctagaccattga

SEQ ID NO: 369 - DNA, 20 bp, Artificial Sequence
  Synthetic polynucleotide
agctccctactttctttaaa

SEQ ID NO: 370 - DNA, 20 bp, Artificial Sequence
  Synthetic polynucleotide
acgagcccctggctttaaat

SEQ ID NO: 371 - DNA, 20 bp, Artificial Sequence
  Synthetic polynucleotide
tcttatctcacattcttgct

SEQ ID NO: 372 - DNA, 20 bp, Artificial Sequence
  Synthetic polynucleotide
aagctccatgcacgcttatg

SEQ ID NO: 373 - DNA, 20 bp, Artificial Sequence
  Synthetic polynucleotide
tctttacagttaattatatc

SEQ ID NO: 374 - DNA, 20 bp, Artificial Sequence
  Synthetic polynucleotide
ttctgacaactcaagtttcg

SEQ ID NO: 375 - DNA, 20 bp, Artificial Sequence
  Synthetic polynucleotide
ctataacgacattcatcata

SEQ ID NO: 376 - DNA, 20 bp, Artificial Sequence
  Synthetic polynucleotide
acaacgccgtagtataggtt

SEQ ID NO: 377 - DNA, 20 bp, Artificial Sequence
  Synthetic polynucleotide
gggtctcgggaaagaaattc

SEQ ID NO: 378 - DNA, 20 bp, Artificial Sequence
  Synthetic polynucleotide
tgatcccccacaatgttggg

SEQ ID NO: 379 - DNA, 20 bp, Artificial Sequence
  Synthetic polynucleotide
tttcgtctcgtttacccgaa

SEQ ID NO: 380 - DNA, 20 bp, Artificial Sequence
  Synthetic polynucleotide
acggttctcacctattcacg

SEQ ID NO: 381 - DNA, 20 bp, Artificial Sequence
  Synthetic polynucleotide
cccactcaaaattacgtagt

SEQ ID NO: 382 - DNA, 20 bp, Artificial Sequence
  Synthetic polynucleotide
atactccctataacctctga

SEQ ID NO: 383 - DNA, 20 bp, Artificial Sequence
  Synthetic polynucleotide
cctttcccgaaacaaatggt

SEQ ID NO: 384 - DNA, 20 bp, Artificial Sequence
  Synthetic polynucleotide
tacgcccgccttagttattc

SEQ ID NO: 385 - DNA, 20 bp, Artificial Sequence
  Synthetic polynucleotide
atctgacgattctaatttaa

SEQ ID NO: 386 - DNA, 20 bp, Artificial Sequence
  Synthetic polynucleotide
ccgctgctgccttgatttcc

SEQ ID NO: 387 - DNA, 20 bp, Artificial Sequence
  Synthetic polynucleotide
gtcccccttccttaatttgt

SEQ ID NO: 388 - DNA, 20 bp, Artificial Sequence
  Synthetic polynucleotide
cgcttacggggtacccttta

SEQ ID NO: 389 - DNA, 20 bp, Artificial Sequence
  Synthetic polynucleotide
tccccacggctcgccattat

SEQ ID NO: 390 - DNA, 20 bp, Artificial Sequence
  Synthetic polynucleotide
ctaaccccagctgcgtatag

SEQ ID NO: 391 - DNA, 20 bp, Artificial Sequence
  Synthetic polynucleotide
tacgaacacatagaacgtcc

SEQ ID NO: 392 - DNA, 20 bp, Artificial Sequence
  Synthetic polynucleotide
tcacccccctctaacccctg

SEQ ID NO: 393 - DNA, 20 bp, Artificial Sequence
  Synthetic polynucleotide
tgatcgcaggataaaaacct

SEQ ID NO: 394 - DNA, 20 bp, Artificial Sequence
  Synthetic polynucleotide
gcacatctaagtcgcatgtt

SEQ ID NO: 395 - DNA, 20 bp, Artificial Sequence
  Synthetic polynucleotide
atgttccgaaaaaaaccgta

SEQ ID NO: 396 - DNA, 20 bp, Artificial Sequence
  Synthetic polynucleotide
acaagtccgaatactacgta

SEQ ID NO: 397 - DNA, 20 bp, Artificial Sequence
  Synthetic polynucleotide
actaaccaatacaagccagg

SEQ ID NO: 398 - DNA, 20 bp, Artificial Sequence
  Synthetic polynucleotide
cacatacttctttgctcagg

SEQ ID NO: 399 - DNA, 20 bp, Artificial Sequence
  Synthetic polynucleotide
actgggcgcccccccctttg

SEQ ID NO: 400 - DNA, 20 bp, Artificial Sequence
  Synthetic polynucleotide
agcgcaccccgcctacttct

SEQ ID NO: 401 - DNA, 20 bp, Artificial Sequence
  Synthetic polynucleotide
accaaaccgcgacatatttc

SEQ ID NO: 402 - DNA, 20 bp, Artificial Sequence
  Synthetic polynucleotide
gctcacctcctgtgttaaat

SEQ ID NO: 403 - DNA, 20 bp, Artificial Sequence
  Synthetic polynucleotide
cgcccccgactcacctaatt

SEQ ID NO: 404 - DNA, 20 bp, Artificial Sequence
  Synthetic polynucleotide
tcccatctatcaactgattg

SEQ ID NO: 405 - DNA, 20 bp, Artificial Sequence
  Synthetic polynucleotide
ccgccccgcctgtttaatga

SEQ ID NO: 406 - DNA, 20 bp, Artificial Sequence
  Synthetic polynucleotide
tcactccccatctacgttgg

SEQ ID NO: 407 - DNA, 20 bp, Artificial Sequence
  Synthetic polynucleotide
tcgcgcccgcaccacttgtt

SEQ ID NO: 408 - DNA, 20 bp, Artificial Sequence
  Synthetic polynucleotide
caccctcctagcttcctgag

SEQ ID NO: 409 - DNA, 20 bp, Artificial Sequence
  Synthetic polynucleotide
acagatctcataatgtggga

SEQ ID NO: 410 - DNA, 20 bp, Artificial Sequence
  Synthetic polynucleotide
gaccctcttactagtatggg

SEQ ID NO: 411 - DNA, 20 bp, Artificial Sequence
  Synthetic polynucleotide
aaatcgcatccaattcctgc

SEQ ID NO: 412 - DNA, 20 bp, Artificial Sequence
  Synthetic polynucleotide
gacatccactagcctccggg

SEQ ID NO: 413 - DNA, 20 bp, Artificial Sequence
  Synthetic polynucleotide
accgttccttcatccacggc

SEQ ID NO: 414 - DNA, 20 bp, Artificial Sequence
  Synthetic polynucleotide
atatatcgtatatcatattt

SEQ ID NO: 415 - DNA, 20 bp, Artificial Sequence
  Synthetic polynucleotide
ttcttgcttaacaaatttca

SEQ ID NO: 416 - DNA, 20 bp, Artificial Sequence
  Synthetic polynucleotide
cctattccacaacattataa

SEQ ID NO: 417 - DNA, 20 bp, Artificial Sequence
  Synthetic polynucleotide
aatactcttacaataaattt

SEQ ID NO: 418 - DNA, 20 bp, Artificial Sequence
  Synthetic polynucleotide
tctaatcctttctcatataa

SEQ ID NO: 419 - DNA, 20 bp, Artificial Sequence
  Synthetic polynucleotide
agattacctcatttatataa

SEQ ID NO: 420 - DNA, 20 bp, Artificial Sequence
  Synthetic polynucleotide
atttacctgataactcaaag

SEQ ID NO: 421 - DNA, 20 bp, Artificial Sequence
  Synthetic polynucleotide
tgaatacctaacaaactaga

SEQ ID NO: 422 - DNA, 20 bp, Artificial Sequence
  Synthetic polynucleotide
tacatacgaaaaacaagttt

SEQ ID NO: 423 - DNA, 20 bp, Artificial Sequence
  Synthetic polynucleotide
agttgacccacataaccatg

SEQ ID NO: 424 - DNA, 20 bp, Artificial Sequence
  Synthetic polynucleotide
cataaccatagaaccattgt

SEQ ID NO: 425 - DNA, 20 bp, Artificial Sequence
  Synthetic polynucleotide
tgtttgcaaaaaattattgt

SEQ ID NO: 426 - DNA, 20 bp, Artificial Sequence
  Synthetic polynucleotide
ttatgacatacccttacgga

SEQ ID NO: 427 - DNA, 20 bp, Artificial Sequence
  Synthetic polynucleotide
gtattacataaccttaccgt

SEQ ID NO: 428 - DNA, 20 bp, Artificial Sequence
  Synthetic polynucleotide
aaaacgcacaataaaacagg

SEQ ID NO: 429 - DNA, 20 bp, Artificial Sequence
  Synthetic polynucleotide
accctccactaatcctattt

SEQ ID NO: 430 - DNA, 20 bp, Artificial Sequence
  Synthetic polynucleotide
catttccttaaacatatttg

SEQ ID NO: 431 - DNA, 20 bp, Artificial Sequence
  Synthetic polynucleotide
gaatttcctttaatatattg

SEQ ID NO: 432 - DNA, 20 bp, Artificial Sequence
  Synthetic polynucleotide
gtccagccaccttctataaa

SEQ ID NO: 433 - DNA, 20 bp, Artificial Sequence
  Synthetic polynucleotide
ttagagcgttaacgtaaaag

SEQ ID NO: 434 - DNA, 20 bp, Artificial Sequence
  Synthetic polynucleotide
tatactccaagccctcataa

SEQ ID NO: 435 - DNA, 20 bp, Artificial Sequence
  Synthetic polynucleotide
ccgttactcctcgctccgta

SEQ ID NO: 436 - DNA, 20 bp, Artificial Sequence
  Synthetic polynucleotide
aaagtcctcatcatacaatg

SEQ ID NO: 437 - DNA, 20 bp, Artificial Sequence
  Synthetic polynucleotide
gtcgaccagaatccgctttg

SEQ ID NO: 438 - DNA, 20 bp, Artificial Sequence
  Synthetic polynucleotide
gtagtcctaaattattcact

SEQ ID NO: 439 - DNA, 20 bp, Artificial Sequence
  Synthetic polynucleotide
gaactacaatatcaatatgg

SEQ ID NO: 440 - DNA, 20 bp, Artificial Sequence
  Synthetic polynucleotide
gattaacttcaccaaattgg

SEQ ID NO: 441 - DNA, 20 bp, Artificial Sequence
  Synthetic polynucleotide
atctaccccaagtacattgg

SEQ ID NO: 442 - DNA, 20 bp, Artificial Sequence
  Synthetic polynucleotide
caaacaccaattccaccgta

SEQ ID NO: 443 - DNA, 20 bp, Artificial Sequence
  Synthetic polynucleotide
tacgtacagtgtagaaccaa

SEQ ID NO: 444 - DNA, 20 bp, Artificial Sequence
  Synthetic polynucleotide
tcgcttcgctctcgtaaatt

SEQ ID NO: 445 - DNA, 20 bp, Artificial Sequence
  Synthetic polynucleotide
ccatgcctgagcgctaaatt

SEQ ID NO: 446 - DNA, 20 bp, Artificial Sequence
  Synthetic polynucleotide
gaaattctggatatcatttg

SEQ ID NO: 447 - DNA, 20 bp, Artificial Sequence
  Synthetic polynucleotide
agattgccgttgttgttaat

SEQ ID NO: 448 - DNA, 20 bp, Artificial Sequence
  Synthetic polynucleotide
cagcaaccactttataaaaa

SEQ ID NO: 449 - DNA, 20 bp, Artificial Sequence
  Synthetic polynucleotide
acacggctaaaataacattg

SEQ ID NO: 450 - DNA, 20 bp, Artificial Sequence
  Synthetic polynucleotide
cgcgacctagactctattaa

SEQ ID NO: 451 - DNA, 20 bp, Artificial Sequence
  Synthetic polynucleotide
acatggcatactttaatcct

SEQ ID NO: 452 - DNA, 20 bp, Artificial Sequence
  Synthetic polynucleotide
ttacatcccttcatacttga

SEQ ID NO: 453 - DNA, 20 bp, Artificial Sequence
  Synthetic polynucleotide
ccctttccaacgagtacaaa

SEQ ID NO: 454 - DNA, 20 bp, Artificial Sequence
  Synthetic polynucleotide
attggacacaaccaactggg

SEQ ID NO: 455 - DNA, 20 bp, Artificial Sequence
  Synthetic polynucleotide
atatttcacttaatatccgg

SEQ ID NO: 456 - DNA, 20 bp, Artificial Sequence
  Synthetic polynucleotide
cctgtactatctttaacaga

SEQ ID NO: 457 - DNA, 20 bp, Artificial Sequence
  Synthetic polynucleotide
caatcccatctccaacgaga

SEQ ID NO: 458 - DNA, 20 bp, Artificial Sequence
  Synthetic polynucleotide
tcaagacacacattcccagt

SEQ ID NO: 459 - DNA, 20 bp, Artificial Sequence
  Synthetic polynucleotide
ctttctcacgcaactaaatt

SEQ ID NO: 460 - DNA, 20 bp, Artificial Sequence
  Synthetic polynucleotide
ccctgactctgcatatttaa

SEQ ID NO: 461 - DNA, 20 bp, Artificial Sequence
  Synthetic polynucleotide
gcgaaccccttagctctttg

SEQ ID NO: 462 - DNA, 20 bp, Artificial Sequence
  Synthetic polynucleotide
gaaatacagtatctattgct

SEQ ID NO: 463 - DNA, 20 bp, Artificial Sequence
  Synthetic polynucleotide
agactactgttgagatattc

SEQ ID NO: 464 - DNA, 20 bp, Artificial Sequence
  Synthetic polynucleotide
cctcaccccctctgcaattt

SEQ ID NO: 465 - DNA, 20 bp, Artificial Sequence
  Synthetic polynucleotide
cgtaggcataaaagtaacta

SEQ ID NO: 466 - DNA, 20 bp, Artificial Sequence
  Synthetic polynucleotide
cgcgcccctcgtcaagattg

SEQ ID NO: 467 - DNA, 20 bp, Artificial Sequence
  Synthetic polynucleotide
ttgtcgcattgattattact

SEQ ID NO: 468 - DNA, 20 bp, Artificial Sequence
  Synthetic polynucleotide
tccacaccgataaatttggt

SEQ ID NO: 469 - DNA, 20 bp, Artificial Sequence
  Synthetic polynucleotide
actagcccacacgtatatgg

SEQ ID NO: 470 - DNA, 20 bp, Artificial Sequence
  Synthetic polynucleotide
gtgcagcctctcttacaggt

SEQ ID NO: 471 - DNA, 20 bp, Artificial Sequence
  Synthetic polynucleotide
ttgctgcgtccaatcctaga

SEQ ID NO: 472 - DNA, 20 bp, Artificial Sequence
  Synthetic polynucleotide
ctcccacgatctaacatggt

SEQ ID NO: 473 - DNA, 20 bp, Artificial Sequence
  Synthetic polynucleotide
gtacaccacctaaacccgaa

SEQ ID NO: 474 - DNA, 20 bp, Artificial Sequence
  Synthetic polynucleotide
ctatcccgttcgctctttaa

SEQ ID NO: 475 - DNA, 20 bp, Artificial Sequence
  Synthetic polynucleotide
atggcgctcttccctttaaa

SEQ ID NO: 476 - DNA, 20 bp, Artificial Sequence
  Synthetic polynucleotide
cctgccccccaactaattag

SEQ ID NO: 477 - DNA, 20 bp, Artificial Sequence
  Synthetic polynucleotide
gtttgtccaccctccaattg

SEQ ID NO: 478 - DNA, 20 bp, Artificial Sequence
  Synthetic polynucleotide
caagatcatcacttctattt

SEQ ID NO: 479 - DNA, 20 bp, Artificial Sequence
  Synthetic polynucleotide
ccgtcccacacactcttatt

SEQ ID NO: 480 - DNA, 20 bp, Artificial Sequence
  Synthetic polynucleotide
ttagtacccatcgccctata

SEQ ID NO: 481 - DNA, 20 bp, Artificial Sequence
  Synthetic polynucleotide
cgtgtccgcccatcttaaga

SEQ ID NO: 482 - DNA, 20 bp, Artificial Sequence
  Synthetic polynucleotide
gtcctcctgatacattcgtt

SEQ ID NO: 483 - DNA, 20 bp, Artificial Sequence
  Synthetic polynucleotide
atcgcgcctcctaactcgtg

SEQ ID NO: 484 - DNA, 20 bp, Artificial Sequence
  Synthetic polynucleotide
cctcacccgcttacctaggt

SEQ ID NO: 485 - DNA, 20 bp, Artificial Sequence
  Synthetic polynucleotide
cgcctccctcagtacccaag

SEQ ID NO: 486 - DNA, 20 bp, Artificial Sequence
  Synthetic polynucleotide
acactaccccaatcccaggg

SEQ ID NO: 487 - DNA, 20 bp, Artificial Sequence
  Synthetic polynucleotide
cactgacctcattcaaacgc

SEQ ID NO: 488 - DNA, 20 bp, Artificial Sequence
  Synthetic polynucleotide
aattatcccatctacaacgc

SEQ ID NO: 489 - DNA, 20 bp, Artificial Sequence
  Synthetic polynucleotide
tctgtactgctaaggtttaa

SEQ ID NO: 490 - DNA, 20 bp, Artificial Sequence
  Synthetic polynucleotide
tcaatcctctggtttaaaaa

SEQ ID NO: 491 - DNA, 20 bp, Artificial Sequence
  Synthetic polynucleotide
ctaagtcatgttggtaaata

SEQ ID NO: 492 - DNA, 20 bp, Artificial Sequence
  Synthetic polynucleotide
tcactacatactggaaatta

SEQ ID NO: 493 - DNA, 20 bp, Artificial Sequence
  Synthetic polynucleotide
tcaacacgttataggtaatt

SEQ ID NO: 494 - DNA, 20 bp, Artificial Sequence
  Synthetic polynucleotide
ttatagcaaatgcatctatc

SEQ ID NO: 495 - DNA, 20 bp, Artificial Sequence
  Synthetic polynucleotide
atgaatctctaaaaacaaac

SEQ ID NO: 496 - DNA, 20 bp, Artificial Sequence
  Synthetic polynucleotide
tacttacgtgttcggataat

SEQ ID NO: 497 - DNA, 20 bp, Artificial Sequence
  Synthetic polynucleotide
atattccgcaatggtacaaa

SEQ ID NO: 498 - DNA, 20 bp, Artificial Sequence
  Synthetic polynucleotide
catgtaccctggtattccac

SEQ ID NO: 499 - DNA, 20 bp, Artificial Sequence
  Synthetic polynucleotide
ggttaccacattaatacata

SEQ ID NO: 500 - DNA, 20 bp, Artificial Sequence
  Synthetic polynucleotide
cgtatccacaactcgtacct

SEQ ID NO: 501 - DNA, 20 bp, Artificial Sequence
  Synthetic polynucleotide
tatatgcaaaattacagcag

SEQ ID NO: 502 - DNA, 20 bp, Artificial Sequence
  Synthetic polynucleotide
tataatcaagtatccgtcgt

SEQ ID NO: 503 - DNA, 20 bp, Artificial Sequence
  Synthetic polynucleotide
cattcccaatatatcaccac

SEQ ID NO: 504 - DNA, 20 bp, Artificial Sequence
  Synthetic polynucleotide
ggtaatcttcttccatttcc

SEQ ID NO: 505 - DNA, 20 bp, Artificial Sequence
  Synthetic polynucleotide
cgtaaacaatttgatatatt

SEQ ID NO: 506 - DNA, 20 bp, Artificial Sequence
  Synthetic polynucleotide
accaatctgtgtggttaaaa

SEQ ID NO: 507 - DNA, 20 bp, Artificial Sequence
  Synthetic polynucleotide
aaaactcattgtgcgaattg

SEQ ID NO: 508 - DNA, 20 bp, Artificial Sequence
  Synthetic polynucleotide
aattgccccgagaggtttag

SEQ ID NO: 509 - DNA, 20 bp, Artificial Sequence
  Synthetic polynucleotide
tctttccaggtcccgtttgc

SEQ ID NO: 510 - DNA, 20 bp, Artificial Sequence
  Synthetic polynucleotide
taaaaacaactggataagtc

SEQ ID NO: 511 - DNA, 20 bp, Artificial Sequence
  Synthetic polynucleotide
gatcatcactcaagggctat

SEQ ID NO: 512 - DNA, 20 bp, Artificial Sequence
  Synthetic polynucleotide
tattatcttcacatggcatg

SEQ ID NO: 513 - DNA, 20 bp, Artificial Sequence
  Synthetic polynucleotide
aagtttcacaaaggttccaa

SEQ ID NO: 514 - DNA, 20 bp, Artificial Sequence
  Synthetic polynucleotide
taatatctagatcccggttc

SEQ ID NO: 515 - DNA, 20 bp, Artificial Sequence
  Synthetic polynucleotide
gtccctcgcccaggaagtga

SEQ ID NO: 516 - DNA, 20 bp, Artificial Sequence
  Synthetic polynucleotide
gtctctcacaatacgaacga

SEQ ID NO: 517 - DNA, 20 bp, Artificial Sequence
  Synthetic polynucleotide
ttcatacagagacagtcgtc

SEQ ID NO: 518 - DNA, 20 bp, Artificial Sequence
  Synthetic polynucleotide
aattgacttacacagacaac

SEQ ID NO: 519 - DNA, 20 bp, Artificial Sequence
  Synthetic polynucleotide
tgaattcctaaatcctttcc

SEQ ID NO: 520 - DNA, 20 bp, Artificial Sequence
  Synthetic polynucleotide
ctatcaccgttggcataaat

SEQ ID NO: 521 - DNA, 20 bp, Artificial Sequence
  Synthetic polynucleotide
agaatccccttggctttata

SEQ ID NO: 522 - DNA, 20 bp, Artificial Sequence
  Synthetic polynucleotide
gagagccgggtctggcaatc

SEQ ID NO: 523 - DNA, 20 bp, Artificial Sequence
  Synthetic polynucleotide
atatagctgtggtcttactt

SEQ ID NO: 524 - DNA, 20 bp, Artificial Sequence
  Synthetic polynucleotide
tgaatacgtttactatgtat

SEQ ID NO: 525 - DNA, 20 bp, Artificial Sequence
  Synthetic polynucleotide
aagtggccttcatctgtatc

SEQ ID NO: 526 - DNA, 20 bp, Artificial Sequence
  Synthetic polynucleotide
ctgcctccgtcatatcaatc

SEQ ID NO: 527 - DNA, 20 bp, Artificial Sequence
  Synthetic polynucleotide
agtagacctgattagcaatt

SEQ ID NO: 528 - DNA, 20 bp, Artificial Sequence
  Synthetic polynucleotide
aagtgactaaacagagcgag

SEQ ID NO: 529 - DNA, 20 bp, Artificial Sequence
  Synthetic polynucleotide
aactagcgctatttggaagg

SEQ ID NO: 530 - DNA, 20 bp, Artificial Sequence
  Synthetic polynucleotide
tatcaccctggcatagacat

SEQ ID NO: 531 - DNA, 20 bp, Artificial Sequence
  Synthetic polynucleotide
tagtaactcaacctcagcag

SEQ ID NO: 532 - DNA, 20 bp, Artificial Sequence
  Synthetic polynucleotide
acgtaactgacgagaaccga

SEQ ID NO: 533 - DNA, 20 bp, Artificial Sequence
  Synthetic polynucleotide
gtttgactttaaacagcagc

SEQ ID NO: 534 - DNA, 20 bp, Artificial Sequence
  Synthetic polynucleotide
gatcatcttggacctaaatt

SEQ ID NO: 535 - DNA, 20 bp, Artificial Sequence
  Synthetic polynucleotide
cctttgctcagacgtttctc

SEQ ID NO: 536 - DNA, 20 bp, Artificial Sequence
  Synthetic polynucleotide
aactttcttaggcgatttaa

SEQ ID NO: 537 - DNA, 20 bp, Artificial Sequence
  Synthetic polynucleotide
ccgcatcgatcactgaaact

SEQ ID NO: 538 - DNA, 20 bp, Artificial Sequence
  Synthetic polynucleotide
tgaaaccctatgcaaatatg

SEQ ID NO: 539 - DNA, 20 bp, Artificial Sequence
  Synthetic polynucleotide
tgaggtcttacggcacattt

SEQ ID NO: 540 - DNA, 20 bp, Artificial Sequence
  Synthetic polynucleotide
ggtccacaatcggtcttgat

SEQ ID NO: 541 - DNA, 20 bp, Artificial Sequence
  Synthetic polynucleotide
ccaacacgcaagcatggtta

SEQ ID NO: 542 - DNA, 20 bp, Artificial Sequence
  Synthetic polynucleotide
agagttcggttgaggcaata

SEQ ID NO: 543 - DNA, 20 bp, Artificial Sequence
  Synthetic polynucleotide
tgaccccccacatatcggat

SEQ ID NO: 544 - DNA, 20 bp, Artificial Sequence
  Synthetic polynucleotide
tcacaacctggatcaaggat

SEQ ID NO: 545 - DNA, 20 bp, Artificial Sequence
  Synthetic polynucleotide
cccataccctgttgacctga

SEQ ID NO: 546 - DNA, 20 bp, Artificial Sequence
  Synthetic polynucleotide
catcatcatatagtgacgac

SEQ ID NO: 547 - DNA, 20 bp, Artificial Sequence
  Synthetic polynucleotide
cttacacccccaatccgaga

SEQ ID NO: 548 - DNA, 20 bp, Artificial Sequence
  Synthetic polynucleotide
tcagcaccgataccgcgaag

SEQ ID NO: 549 - DNA, 20 bp, Artificial Sequence
  Synthetic polynucleotide
agatgtcgacgaggctttca

SEQ ID NO: 550 - DNA, 20 bp, Artificial Sequence
  Synthetic polynucleotide
tctagactcgaggaatttcg

SEQ ID NO: 551 - DNA, 20 bp, Artificial Sequence
  Synthetic polynucleotide
tccctcccctctgggcattt

SEQ ID NO: 552 - DNA, 20 bp, Artificial Sequence
  Synthetic polynucleotide
cgctccctgccggtaattac

SEQ ID NO: 553 - DNA, 20 bp, Artificial Sequence
  Synthetic polynucleotide
cgcacgccctttctgcatct

SEQ ID NO: 554 - DNA, 20 bp, Artificial Sequence
  Synthetic polynucleotide
gctcatccccactctgctct

SEQ ID NO: 555 - DNA, 20 bp, Artificial Sequence
  Synthetic polynucleotide
cattgtcccccaccagctag

SEQ ID NO: 556 - DNA, 20 bp, Artificial Sequence
  Synthetic polynucleotide
cctctcctagagccatgtca

SEQ ID NO: 557 - DNA, 20 bp, Artificial Sequence
  Synthetic polynucleotide
tttaagctcgggaaaagtct

SEQ ID NO: 558 - DNA, 20 bp, Artificial Sequence
  Synthetic polynucleotide
gtacaccattagtgagtgag

SEQ ID NO: 559 - DNA, 20 bp, Artificial Sequence
  Synthetic polynucleotide
ctttgtcatcgttccgacga

SEQ ID NO: 560 - DNA, 20 bp, Artificial Sequence
  Synthetic polynucleotide
tccggacaggaagaggcata

SEQ ID NO: 561 - DNA, 20 bp, Artificial Sequence
  Synthetic polynucleotide
cctagtccctaaatcaccac

SEQ ID NO: 562 - DNA, 20 bp, Artificial Sequence
  Synthetic polynucleotide
accagtcgacaatgaaccaa

SEQ ID NO: 563 - DNA, 20 bp, Artificial Sequence
  Synthetic polynucleotide
tcactcctacgctaaaacgc

SEQ ID NO: 564 - DNA, 20 bp, Artificial Sequence
  Synthetic polynucleotide
tatactcccttaccttatta

SEQ ID NO: 565 - DNA, 20 bp, Artificial Sequence
  Synthetic polynucleotide
tctaatctttaggtatttct

SEQ ID NO: 566 - DNA, 20 bp, Artificial Sequence
  Synthetic polynucleotide
aaacgacttgtacattaatt

SEQ ID NO: 567 - DNA, 20 bp, Artificial Sequence
  Synthetic polynucleotide
caagaacatagcagctttct

SEQ ID NO: 568 - DNA, 20 bp, Artificial Sequence
  Synthetic polynucleotide
aatctccaagattgtctttc

SEQ ID NO: 569 - DNA, 20 bp, Artificial Sequence
  Synthetic polynucleotide
tcgtacctctaattgattat

SEQ ID NO: 570 - DNA, 20 bp, Artificial Sequence
  Synthetic polynucleotide
gaaaatcactactgaaattc

SEQ ID NO: 571 - DNA, 20 bp, Artificial Sequence
  Synthetic polynucleotide
atatctcaattagactatag

SEQ ID NO: 572 - DNA, 20 bp, Artificial Sequence
  Synthetic polynucleotide
actttaccatcgtgtataaa

SEQ ID NO: 573 - DNA, 20 bp, Artificial Sequence
  Synthetic polynucleotide
agatatcatgtgactaacta

SEQ ID NO: 574 - DNA, 20 bp, Artificial Sequence
  Synthetic polynucleotide
gtatatcattcgatcaagat

SEQ ID NO: 575 - DNA, 20 bp, Artificial Sequence
  Synthetic polynucleotide
aaatcacctccttataccct

SEQ ID NO: 576 - DNA, 20 bp, Artificial Sequence
  Synthetic polynucleotide
atagtactagcacagaccag

SEQ ID NO: 577 - DNA, 20 bp, Artificial Sequence
  Synthetic polynucleotide
ctatgacaccgaaatacgaa

SEQ ID NO: 578 - DNA, 20 bp, Artificial Sequence
  Synthetic polynucleotide
atttgacaaggcaacatcat

SEQ ID NO: 579 - DNA, 20 bp, Artificial Sequence
  Synthetic polynucleotide
cggcctctatttagtttatt

SEQ ID NO: 580 - DNA, 20 bp, Artificial Sequence
  Synthetic polynucleotide
ccactgcaaccggcattatt

SEQ ID NO: 581 - DNA, 20 bp, Artificial Sequence
  Synthetic polynucleotide
actgtacggacggattaatt

SEQ ID NO: 582 - DNA, 20 bp, Artificial Sequence
  Synthetic polynucleotide
acgctacatttccctagtta

SEQ ID NO: 583 - DNA, 20 bp, Artificial Sequence
  Synthetic polynucleotide
accatgcaatggtcaaataa

SEQ ID NO: 584 - DNA, 20 bp, Artificial Sequence
  Synthetic polynucleotide
aaaaatcttggtcttagatt

SEQ ID NO: 585 - DNA, 20 bp, Artificial Sequence
  Synthetic polynucleotide
cgactgcaatacattgaaat

SEQ ID NO: 586 - DNA, 20 bp, Artificial Sequence
  Synthetic polynucleotide
ggagctcatagttcagctca

SEQ ID NO: 587 - DNA, 20 bp, Artificial Sequence
  Synthetic polynucleotide
tctaaacgctaaaggcatag

SEQ ID NO: 588 - DNA, 20 bp, Artificial Sequence
  Synthetic polynucleotide
acttggcccaaataaaggaa

SEQ ID NO: 589 - DNA, 20 bp, Artificial Sequence
  Synthetic polynucleotide
tataaactttacttgtgcgg

SEQ ID NO: 590 - DNA, 20 bp, Artificial Sequence
  Synthetic polynucleotide
atacgacatcacactagagt

SEQ ID NO: 591 - DNA, 20 bp, Artificial Sequence
  Synthetic polynucleotide
cgtgaactatgtgacaacag

SEQ ID NO: 592 - DNA, 20 bp, Artificial Sequence
  Synthetic polynucleotide
agatcacttaaggtcactgt

SEQ ID NO: 593 - DNA, 20 bp, Artificial Sequence
  Synthetic polynucleotide
tatatgcttagcagactggc

SEQ ID NO: 594 - DNA, 20 bp, Artificial Sequence
  Synthetic polynucleotide
gtccttctggtactgtttaa

SEQ ID NO: 595 - DNA, 20 bp, Artificial Sequence
  Synthetic polynucleotide
tatattctttacacctttca

SEQ ID NO: 596 - DNA, 20 bp, Artificial Sequence
  Synthetic polynucleotide
gttgtgcccctctttcttct

SEQ ID NO: 597 - DNA, 20 bp, Artificial Sequence
  Synthetic polynucleotide
cgactacctattggcctttg

SEQ ID NO: 598 - DNA, 20 bp, Artificial Sequence
  Synthetic polynucleotide
acatacctgcaagcttactt

SEQ ID NO: 599 - DNA, 20 bp, Artificial Sequence
  Synthetic polynucleotide
tccgatcgtacgtactttcg

SEQ ID NO: 600 - DNA, 20 bp, Artificial Sequence
  Synthetic polynucleotide
acattacaataatgctgact

SEQ ID NO: 601 - DNA, 20 bp, Artificial Sequence
  Synthetic polynucleotide
atgtctctctcgaggtctca

SEQ ID NO: 602 - DNA, 20 bp, Artificial Sequence
  Synthetic polynucleotide
gtgaagcaagagcggtaatc

SEQ ID NO: 603 - DNA, 20 bp, Artificial Sequence
  Synthetic polynucleotide
attagcctaccaactcgaat

SEQ ID NO: 604 - DNA, 20 bp, Artificial Sequence
  Synthetic polynucleotide
aaactgcagcatcatgatga

SEQ ID NO: 605 - DNA, 20 bp, Artificial Sequence
  Synthetic polynucleotide
agtatcctattctatcgtgt

SEQ ID NO: 606 - DNA, 20 bp, Artificial Sequence
  Synthetic polynucleotide
tgaacccgcagttataacgc

SEQ ID NO: 607 - DNA, 20 bp, Artificial Sequence
  Synthetic polynucleotide
taagaactacagttacccag

SEQ ID NO: 608 - DNA, 20 bp, Artificial Sequence
  Synthetic polynucleotide
acaccgcaataaagacagga

SEQ ID NO: 609 - DNA, 20 bp, Artificial Sequence
  Synthetic polynucleotide
acactcctcgtgcgatttag

SEQ ID NO: 610 - DNA, 20 bp, Artificial Sequence
  Synthetic polynucleotide
aattctcattcggctaaaat

SEQ ID NO: 611 - DNA, 20 bp, Artificial Sequence
  Synthetic polynucleotide
cctttacagactgtatttac

SEQ ID NO: 612 - DNA, 20 bp, Artificial Sequence
  Synthetic polynucleotide
tcgagcctttcatggtaacc

SEQ ID NO: 613 - DNA, 20 bp, Artificial Sequence
  Synthetic polynucleotide
tgaagcccccgatgtagtat

SEQ ID NO: 614 - DNA, 20 bp, Artificial Sequence
  Synthetic polynucleotide
cgccgacattagcgatattg

SEQ ID NO: 615 - DNA, 20 bp, Artificial Sequence
  Synthetic polynucleotide
ccctaacacgcttaagagct

SEQ ID NO: 616 - DNA, 20 bp, Artificial Sequence
  Synthetic polynucleotide
tacctgcgcttgcgactaac

SEQ ID NO: 617 - DNA, 20 bp, Artificial Sequence
  Synthetic polynucleotide
cagtaaccagtgcattacca

SEQ ID NO: 618 - DNA, 20 bp, Artificial Sequence
  Synthetic polynucleotide
ctcgcactttcctacctacc

SEQ ID NO: 619 - DNA, 20 bp, Artificial Sequence
  Synthetic polynucleotide
cccttcccatgtcgcacgga

SEQ ID NO: 620 - DNA, 20 bp, Artificial Sequence
  Synthetic polynucleotide
cgtacactctgatgattcgg

SEQ ID NO: 621 - DNA, 20 bp, Artificial Sequence
  Synthetic polynucleotide
aacctactactctgaccaga

SEQ ID NO: 622 - DNA, 20 bp, Artificial Sequence
  Synthetic polynucleotide
acacacccagcatcatcagc

SEQ ID NO: 623 - DNA, 20 bp, Artificial Sequence
  Synthetic polynucleotide
cgcctgctatgttccaacaa

SEQ ID NO: 624 - DNA, 20 bp, Artificial Sequence
  Synthetic polynucleotide
ctcaccccgcctcggtattt

SEQ ID NO: 625 - DNA, 20 bp, Artificial Sequence
  Synthetic polynucleotide
ctggcgcacgaggcggttct

SEQ ID NO: 626 - DNA, 20 bp, Artificial Sequence
  Synthetic polynucleotide
cccttccatcgccactttcg

SEQ ID NO: 627 - DNA, 20 bp, Artificial Sequence
  Synthetic polynucleotide
tcctcccgtgccactttcca

SEQ ID NO: 628 - DNA, 20 bp, Artificial Sequence
  Synthetic polynucleotide
cgccagctgttagtcattta

SEQ ID NO: 629 - DNA, 20 bp, Artificial Sequence
  Synthetic polynucleotide
gcgcaacggcggtttctaaa

SEQ ID NO: 630 - DNA, 20 bp, Artificial Sequence
  Synthetic polynucleotide
tcccaacactcaccgtccgt

SEQ ID NO: 631 - DNA, 20 bp, Artificial Sequence
  Synthetic polynucleotide
cttccactgttacgatcgat

SEQ ID NO: 632 - DNA, 20 bp, Artificial Sequence
  Synthetic polynucleotide
cgccgccctccatccatgtg

SEQ ID NO: 633 - DNA, 20 bp, Artificial Sequence
  Synthetic polynucleotide
agcaacctacctacgccgca

SEQ ID NO: 634 - DNA, 20 bp, Artificial Sequence
  Synthetic polynucleotide
cacatgctccccgactaagt

SEQ ID NO: 635 - DNA, 20 bp, Artificial Sequence
  Synthetic polynucleotide
ccctctccagctgcccctgc

SEQ ID NO: 636 - DNA, 20 bp, Artificial Sequence
  Synthetic polynucleotide
tgtcgactcttctaaaccga

SEQ ID NO: 637 - DNA, 20 bp, Artificial Sequence
  Synthetic polynucleotide
acgcaccgtaagaacaaaga

SEQ ID NO: 638 - DNA, 20 bp, Artificial Sequence
  Synthetic polynucleotide
aacgcccctttatacatcgg

SEQ ID NO: 639 - DNA, 20 bp, Artificial Sequence
  Synthetic polynucleotide
taaataccgcgatctttatt

SEQ ID NO: 640 - DNA, 20 bp, Artificial Sequence
  Synthetic polynucleotide
gaacatcgcctgaaataatg

SEQ ID NO: 641 - DNA, 20 bp, Artificial Sequence
  Synthetic polynucleotide
tctatcctacttgatattat

SEQ ID NO: 642 - DNA, 20 bp, Artificial Sequence
  Synthetic polynucleotide
catcaacattgtcttcttat

SEQ ID NO: 643 - DNA, 20 bp, Artificial Sequence
  Synthetic polynucleotide
tttatgctcatgcaataata

SEQ ID NO: 644 - DNA, 20 bp, Artificial Sequence
  Synthetic polynucleotide
gcatgtcagtaaacgaattt

SEQ ID NO: 645 - DNA, 20 bp, Artificial Sequence
  Synthetic polynucleotide
gactatcaatatggtggaat

SEQ ID NO: 646 - DNA, 20 bp, Artificial Sequence
  Synthetic polynucleotide
agatgtccagttaacaaata

SEQ ID NO: 647 - DNA, 20 bp, Artificial Sequence
  Synthetic polynucleotide
tataatctagcaaatttcaa

SEQ ID NO: 648 - DNA, 20 bp, Artificial Sequence
  Synthetic polynucleotide
ttgactcggattaccagaca

SEQ ID NO: 649 - DNA, 20 bp, Artificial Sequence
  Synthetic polynucleotide
tttatcctgtaatgcaagta

SEQ ID NO: 650 - DNA, 20 bp, Artificial Sequence
  Synthetic polynucleotide
aattatccatgcataaaagc

SEQ ID NO: 651 - DNA, 20 bp, Artificial Sequence
  Synthetic polynucleotide
taacatcgactatacaagaa

SEQ ID NO: 652 - DNA, 20 bp, Artificial Sequence
  Synthetic polynucleotide
aatgcccagtgaaagaccag

SEQ ID NO: 653 - DNA, 20 bp, Artificial Sequence
  Synthetic polynucleotide
gtaatgctatagtaaaacgt

SEQ ID NO: 654 - DNA, 20 bp, Artificial Sequence
  Synthetic polynucleotide
tacatccgtaaaggttattt

SEQ ID NO: 655 - DNA, 20 bp, Artificial Sequence
  Synthetic polynucleotide
agaattctgcgtccatatta

SEQ ID NO: 656 - DNA, 20 bp, Artificial Sequence
  Synthetic polynucleotide
attattcaatgactttaact

SEQ ID NO: 657 - DNA, 20 bp, Artificial Sequence
  Synthetic polynucleotide
catactcactagttgtttag

SEQ ID NO: 658 - DNA, 20 bp, Artificial Sequence
  Synthetic polynucleotide
agatgccccattgcacaaat

SEQ ID NO: 659 - DNA, 20 bp, Artificial Sequence
  Synthetic polynucleotide
tacatccgaatcgcataatg

SEQ ID NO: 660 - DNA, 20 bp, Artificial Sequence
  Synthetic polynucleotide
aatagccctgtcaggctata

SEQ ID NO: 661 - DNA, 20 bp, Artificial Sequence
  Synthetic polynucleotide
aaagtccaacgttagatatg

SEQ ID NO: 662 - DNA, 20 bp, Artificial Sequence
  Synthetic polynucleotide
caacttcccgaaatgcggtt

SEQ ID NO: 663 - DNA, 20 bp, Artificial Sequence
  Synthetic polynucleotide
tcaaatccgtcttacaagaa

SEQ ID NO: 664 - DNA, 20 bp, Artificial Sequence
  Synthetic polynucleotide
gtcagtcaggaatccgaaac

SEQ ID NO: 665 - DNA, 20 bp, Artificial Sequence
  Synthetic polynucleotide
gaacccctcgatgtttgcta

SEQ ID NO: 666 - DNA, 20 bp, Artificial Sequence
  Synthetic polynucleotide
ataagtcaatctagctgtga

SEQ ID NO: 667 - DNA, 20 bp, Artificial Sequence
  Synthetic polynucleotide
ttacttcctgatcacaagac

SEQ ID NO: 668 - DNA, 20 bp, Artificial Sequence
  Synthetic polynucleotide
tatcctccgagaacttgggt

SEQ ID NO: 669 - DNA, 20 bp, Artificial Sequence
  Synthetic polynucleotide
atatatcgtttactatttac

SEQ ID NO: 670 - DNA, 20 bp, Artificial Sequence
  Synthetic polynucleotide
gacactcgttggctttaaat

SEQ ID NO: 671 - DNA, 20 bp, Artificial Sequence
  Synthetic polynucleotide
ctgggactgaagggatttag

SEQ ID NO: 672 - DNA, 20 bp, Artificial Sequence
  Synthetic polynucleotide
ctgacgcatactgggtaata

SEQ ID NO: 673 - DNA, 20 bp, Artificial Sequence
  Synthetic polynucleotide
tcctttcggtttagtctaac

SEQ ID NO: 674 - DNA, 20 bp, Artificial Sequence
  Synthetic polynucleotide
ctttctcgctttcattctca

SEQ ID NO: 675 - DNA, 20 bp, Artificial Sequence
  Synthetic polynucleotide
tacgttcccgattactatac

SEQ ID NO: 676 - DNA, 20 bp, Artificial Sequence
  Synthetic polynucleotide
aagaatcaacacttacaaac

SEQ ID NO: 677 - DNA, 20 bp, Artificial Sequence
  Synthetic polynucleotide
gcttaacagcggagtactca

SEQ ID NO: 678 - DNA, 20 bp, Artificial Sequence
  Synthetic polynucleotide
acaggaccgttgtagttagc

SEQ ID NO: 679 - DNA, 20 bp, Artificial Sequence
  Synthetic polynucleotide
cattaacgatcaaccatagc

SEQ ID NO: 680 - DNA, 20 bp, Artificial Sequence
  Synthetic polynucleotide
catccgctcagacaggtgaa

SEQ ID NO: 681 - DNA, 20 bp, Artificial Sequence
  Synthetic polynucleotide
aacgcacaacagatttcaga

SEQ ID NO: 682 - DNA, 20 bp, Artificial Sequence
  Synthetic polynucleotide
acgcaccaagtgatgattgt

SEQ ID NO: 683 - DNA, 20 bp, Artificial Sequence
  Synthetic polynucleotide
gagactccacacgtaaacgg

SEQ ID NO: 684 - DNA, 20 bp, Artificial Sequence
  Synthetic polynucleotide
accatgcccgatggaattaa

SEQ ID NO: 685 - DNA, 20 bp, Artificial Sequence
  Synthetic polynucleotide
atcatgctcggccctattat

SEQ ID NO: 686 - DNA, 20 bp, Artificial Sequence
  Synthetic polynucleotide
gcatacctatccgtttatta

SEQ ID NO: 687 - DNA, 20 bp, Artificial Sequence
  Synthetic polynucleotide
gtaaccccaatcgtttcttt

SEQ ID NO: 688 - DNA, 20 bp, Artificial Sequence
  Synthetic polynucleotide
caggtgcgcgccgtcgatta

SEQ ID NO: 689 - DNA, 20 bp, Artificial Sequence
  Synthetic polynucleotide
agcagacgttcggggaaatt

SEQ ID NO: 690 - DNA, 20 bp, Artificial Sequence
  Synthetic polynucleotide
gttatacacggcaatttacc

SEQ ID NO: 691 - DNA, 20 bp, Artificial Sequence
  Synthetic polynucleotide
cggggccaaccggtgaaaac

SEQ ID NO: 692 - DNA, 20 bp, Artificial Sequence
  Synthetic polynucleotide
agcacgcaaaaaaggttctc

SEQ ID NO: 693 - DNA, 20 bp, Artificial Sequence
  Synthetic polynucleotide
tgcattctgagtcaggaccc

SEQ ID NO: 694 - DNA, 20 bp, Artificial Sequence
  Synthetic polynucleotide
tacccgccataacgccgcat

SEQ ID NO: 695 - DNA, 20 bp, Artificial Sequence
  Synthetic polynucleotide
gagagtccagtatgttagga

SEQ ID NO: 696 - DNA, 20 bp, Artificial Sequence
  Synthetic polynucleotide
cataccctaacgatcacacg

SEQ ID NO: 697 - DNA, 20 bp, Artificial Sequence
  Synthetic polynucleotide
ttaaggcgacgttatatcgc

SEQ ID NO: 698 - DNA, 20 bp, Artificial Sequence
  Synthetic polynucleotide
gtacttcaaattgacactga

SEQ ID NO: 699 - DNA, 20 bp, Artificial Sequence
  Synthetic polynucleotide
ggttggctttcctacttcta

SEQ ID NO: 700 - DNA, 20 bp, Artificial Sequence
  Synthetic polynucleotide
ggcatccgtgttctatttct

SEQ ID NO: 701 - DNA, 20 bp, Artificial Sequence
  Synthetic polynucleotide
ctttcgcccttcgtctttca

SEQ ID NO: 702 - DNA, 20 bp, Artificial Sequence
  Synthetic polynucleotide
tgccctcgggacgcgtctaa

SEQ ID NO: 703 - DNA, 20 bp, Artificial Sequence
  Synthetic polynucleotide
tcgtctctcatacggcaatt

SEQ ID NO: 704 - DNA, 20 bp, Artificial Sequence
  Synthetic polynucleotide
tccgtccgctgtgtcataca

SEQ ID NO: 705 - DNA, 20 bp, Artificial Sequence
  Synthetic polynucleotide
ggccgtcgcattggtccaaa

SEQ ID NO: 706 - DNA, 20 bp, Artificial Sequence
  Synthetic polynucleotide
gctgcccctggagttcacat

SEQ ID NO: 707 - DNA, 20 bp, Artificial Sequence
  Synthetic polynucleotide
agcacgcgacgctgcaatac

SEQ ID NO: 708 - DNA, 20 bp, Artificial Sequence
  Synthetic polynucleotide
tgcgcgcttcctacgataga

SEQ ID NO: 709 - DNA, 20 bp, Artificial Sequence
  Synthetic polynucleotide
gcactacagctcttcacgca

SEQ ID NO: 710 - DNA, 20 bp, Artificial Sequence
  Synthetic polynucleotide
cctccacttgccactacaac

SEQ ID NO: 711 - DNA, 20 bp, Artificial Sequence
  Synthetic polynucleotide
atacccccgaactacaccgc

SEQ ID NO: 712 - DNA, 20 bp, Artificial Sequence
  Synthetic polynucleotide
cttgagcaatcacgtacgtg

SEQ ID NO: 713 - DNA, 20 bp, Artificial Sequence
  Synthetic polynucleotide
agtagcccgtgactcaacgt

SEQ ID NO: 714 - DNA, 20 bp, Artificial Sequence
  Synthetic polynucleotide
aagatacattaaactttatt

SEQ ID NO: 715 - DNA, 20 bp, Artificial Sequence
  Synthetic polynucleotide
tattatctgtaagattaaat

SEQ ID NO: 716 - DNA, 20 bp, Artificial Sequence
  Synthetic polynucleotide
gattcgcatatctaatttaa

SEQ ID NO: 717 - DNA, 20 bp, Artificial Sequence
  Synthetic polynucleotide
aatgtaccggagctaatttc

SEQ ID NO: 718 - DNA, 20 bp, Artificial Sequence
  Synthetic polynucleotide
tatcctcacttcttgctgtt

SEQ ID NO: 719 - DNA, 20 bp, Artificial Sequence
  Synthetic polynucleotide
taaacgcttcacggttatag

SEQ ID NO: 720 - DNA, 20 bp, Artificial Sequence
  Synthetic polynucleotide
ttgattccagggaaattacg

SEQ ID NO: 721 - DNA, 20 bp, Artificial Sequence
  Synthetic polynucleotide
ttagagcattatccaaagaa

SEQ ID NO: 722 - DNA, 20 bp, Artificial Sequence
  Synthetic polynucleotide
tctaatcataacataatata

SEQ ID NO: 723 - DNA, 20 bp, Artificial Sequence
  Synthetic polynucleotide
gtattacgtcaagtatatgc

SEQ ID NO: 724 - DNA, 20 bp, Artificial Sequence
  Synthetic polynucleotide
aataacctggttagaaacac

SEQ ID NO: 725 - DNA, 20 bp, Artificial Sequence
  Synthetic polynucleotide
gttattcatatatagaggaa

SEQ ID NO: 726 - DNA, 20 bp, Artificial Sequence
  Synthetic polynucleotide
gaatgtccaataaattgtga

SEQ ID NO: 727 - DNA, 20 bp, Artificial Sequence
  Synthetic polynucleotide
aaacttcgagatttaactgt

SEQ ID NO: 728 - DNA, 20 bp, Artificial Sequence
  Synthetic polynucleotide
tatgaacaacagaagattgt

SEQ ID NO: 729 - DNA, 20 bp, Artificial Sequence
  Synthetic polynucleotide
caaactcagctgcttaaatt

SEQ ID NO: 730 - DNA, 20 bp, Artificial Sequence
  Synthetic polynucleotide
aatgtactcttgctgaattt

SEQ ID NO: 731 - DNA, 20 bp, Artificial Sequence
  Synthetic polynucleotide
gctctacttctatattattc

SEQ ID NO: 732 - DNA, 20 bp, Artificial Sequence
  Synthetic polynucleotide
tatgcgctgacctttaatct

SEQ ID NO: 733 - DNA, 20 bp, Artificial Sequence
  Synthetic polynucleotide
atcggtcgatttatcgttct

SEQ ID NO: 734 - DNA, 20 bp, Artificial Sequence
  Synthetic polynucleotide
aacaggccgtacggaaattt

SEQ ID NO: 735 - DNA, 20 bp, Artificial Sequence
  Synthetic polynucleotide
ctactacaaggttctcaatc

SEQ ID NO: 736 - DNA, 20 bp, Artificial Sequence
  Synthetic polynucleotide
taaggacccaaacgaataca

SEQ ID NO: 737 - DNA, 20 bp, Artificial Sequence
  Synthetic polynucleotide
tctcatcaggggaatgctta

SEQ ID NO: 738 - DNA, 20 bp, Artificial Sequence
  Synthetic polynucleotide
atatttcctatctctctcga

SEQ ID NO: 739 - DNA, 20 bp, Artificial Sequence
  Synthetic polynucleotide
agtataccacatcccgtgtt

SEQ ID NO: 740 - DNA, 20 bp, Artificial Sequence
  Synthetic polynucleotide
catgtactaattctagcatc

SEQ ID NO: 741 - DNA, 20 bp, Artificial Sequence
  Synthetic polynucleotide
acctgccggatgatgacatt

SEQ ID NO: 742 - DNA, 20 bp, Artificial Sequence
  Synthetic polynucleotide
gtatggcttgataatcacgc

SEQ ID NO: 743 - DNA, 20 bp, Artificial Sequence
  Synthetic polynucleotide
cgataacggtatagaactgc

SEQ ID NO: 744 - DNA, 20 bp, Artificial Sequence
  Synthetic polynucleotide
aattggcagtcctttaaatt

SEQ ID NO: 745 - DNA, 20 bp, Artificial Sequence
  Synthetic polynucleotide
tttgttctacctagttaata

SEQ ID NO: 746 - DNA, 20 bp, Artificial Sequence
  Synthetic polynucleotide
cgacagctgcattaataatt

SEQ ID NO: 747 - DNA, 20 bp, Artificial Sequence
  Synthetic polynucleotide
attctccaactacccaaaac

SEQ ID NO: 748 - DNA, 20 bp, Artificial Sequence
  Synthetic polynucleotide
gtacagcgactaataattat

SEQ ID NO: 749 - DNA, 20 bp, Artificial Sequence
  Synthetic polynucleotide
tacctcctcatcctgatctt

SEQ ID NO: 750 - DNA, 20 bp, Artificial Sequence
  Synthetic polynucleotide
tccgctcgtattgaacgtac

SEQ ID NO: 751 - DNA, 20 bp, Artificial Sequence
  Synthetic polynucleotide
cagcaccctaggtcacaatc

SEQ ID NO: 752 - DNA, 20 bp, Artificial Sequence
  Synthetic polynucleotide
catccacttcgtaaacatac

SEQ ID NO: 753 - DNA, 20 bp, Artificial Sequence
  Synthetic polynucleotide
tcggtacgtcactatctcaa

SEQ ID NO: 754 - DNA, 20 bp, Artificial Sequence
  Synthetic polynucleotide
agcggccactcccgagtata

SEQ ID NO: 755 - DNA, 20 bp, Artificial Sequence
  Synthetic polynucleotide
gaacatctacggacaaaccg

SEQ ID NO: 756 - DNA, 20 bp, Artificial Sequence
  Synthetic polynucleotide
tggcttcatgatttctccgc

SEQ ID NO: 757 - DNA, 20 bp, Artificial Sequence
  Synthetic polynucleotide
cttgggcacataattaccga

SEQ ID NO: 758 - DNA, 20 bp, Artificial Sequence
  Synthetic polynucleotide
aaagcacggataaccacggt

SEQ ID NO: 759 - DNA, 20 bp, Artificial Sequence
  Synthetic polynucleotide
gctttccaaaaggctttatc

SEQ ID NO: 760 - DNA, 20 bp, Artificial Sequence
  Synthetic polynucleotide
caatggcgcggcccttattt

SEQ ID NO: 761 - DNA, 20 bp, Artificial Sequence
  Synthetic polynucleotide
aaccctctggttatgtattt

SEQ ID NO: 762 - DNA, 20 bp, Artificial Sequence
  Synthetic polynucleotide
tgagaacgcggtctataact

SEQ ID NO: 763 - DNA, 20 bp, Artificial Sequence
  Synthetic polynucleotide
cccccccttgtctcctgatt

SEQ ID NO: 764 - DNA, 20 bp, Artificial Sequence
  Synthetic polynucleotide
accgtgctgtggtcacataa

SEQ ID NO: 765 - DNA, 20 bp, Artificial Sequence
  Synthetic polynucleotide
ataaaacgaattgatagtta

SEQ ID NO: 766 - DNA, 20 bp, Artificial Sequence
  Synthetic polynucleotide
tccccacaactaagtcaata

SEQ ID NO: 767 - DNA, 20 bp, Artificial Sequence
  Synthetic polynucleotide
atttagcacgaaagtttgcc

SEQ ID NO: 768 - DNA, 20 bp, Artificial Sequence
  Synthetic polynucleotide
aacatgccatatcgtcgcta

SEQ ID NO: 769 - DNA, 20 bp, Artificial Sequence
  Synthetic polynucleotide
gcactactttgcgacaacct

SEQ ID NO: 770 - DNA, 20 bp, Artificial Sequence
  Synthetic polynucleotide
agtccgcattatacttgatg

SEQ ID NO: 771 - DNA, 20 bp, Artificial Sequence
  Synthetic polynucleotide
cacccacagcttattgacgg

SEQ ID NO: 772 - DNA, 20 bp, Artificial Sequence
  Synthetic polynucleotide
atgcagcgagcattcttggg

SEQ ID NO: 773 - DNA, 20 bp, Artificial Sequence
  Synthetic polynucleotide
tcttaaccttactcaagaga

SEQ ID NO: 774 - DNA, 20 bp, Artificial Sequence
  Synthetic polynucleotide
aacgtgcaacccccctttct

SEQ ID NO: 775 - DNA, 20 bp, Artificial Sequence
  Synthetic polynucleotide
acctctcacccgtcttgttt

SEQ ID NO: 776 - DNA, 20 bp, Artificial Sequence
  Synthetic polynucleotide
ccccctcgtcctaagatttc

SEQ ID NO: 777 - DNA, 20 bp, Artificial Sequence
  Synthetic polynucleotide
tgcgagccttcgtatcctat

SEQ ID NO: 778 - DNA, 20 bp, Artificial Sequence
  Synthetic polynucleotide
cgggctcattgggaacttcc

SEQ ID NO: 779 - DNA, 20 bp, Artificial Sequence
  Synthetic polynucleotide
ccgcgccgagccatccatct

SEQ ID NO: 780 - DNA, 20 bp, Artificial Sequence
  Synthetic polynucleotide
tcacatcaatacattgctct

SEQ ID NO: 781 - DNA, 20 bp, Artificial Sequence
  Synthetic polynucleotide
tcgacgcctcactctttgtc

SEQ ID NO: 782 - DNA, 20 bp, Artificial Sequence
  Synthetic polynucleotide
cagcgccggtccaagtctga

SEQ ID NO: 783 - DNA, 20 bp, Artificial Sequence
  Synthetic polynucleotide
aacgtccagcatatcccgtc

SEQ ID NO: 784 - DNA, 20 bp, Artificial Sequence
  Synthetic polynucleotide
atgcaccagatgaattcatg

SEQ ID NO: 785 - DNA, 20 bp, Artificial Sequence
  Synthetic polynucleotide
aaccaacacagcacatgcgt

SEQ ID NO: 786 - DNA, 20 bp, Artificial Sequence
  Synthetic polynucleotide
aaatgccactaccacacagt

SEQ ID NO: 787 - DNA, 20 bp, Artificial Sequence
  Synthetic polynucleotide
ccgttccccacgtacacagc

SEQ ID NO: 788 - DNA, 20 bp, Artificial Sequence
  Synthetic polynucleotide
attaccctcattactaccgc

SEQ ID NO: 789 - DNA, 20 bp, Artificial Sequence
  Synthetic polynucleotide
agtattcattcattctttaa

SEQ ID NO: 790 - DNA, 20 bp, Artificial Sequence
  Synthetic polynucleotide
gccatccttcttatattaac

SEQ ID NO: 791 - DNA, 20 bp, Artificial Sequence
  Synthetic polynucleotide
aaacttctaccgagtaaatt

SEQ ID NO: 792 - DNA, 20 bp, Artificial Sequence
  Synthetic polynucleotide
tctatgcatagaataaaact

SEQ ID NO: 793 - DNA, 20 bp, Artificial Sequence
  Synthetic polynucleotide
ggtaacctatgatataatac

SEQ ID NO: 794 - DNA, 20 bp, Artificial Sequence
  Synthetic polynucleotide
gttgatctaatactaaaatc

SEQ ID NO: 795 - DNA, 20 bp, Artificial Sequence
  Synthetic polynucleotide
ctatgccattaaaaaaattc

SEQ ID NO: 796 - DNA, 20 bp, Artificial Sequence
  Synthetic polynucleotide
acagaacgtgtttacgatct

SEQ ID NO: 797 - DNA, 20 bp, Artificial Sequence
  Synthetic polynucleotide
attaagcattattgctgttc

SEQ ID NO: 798 - DNA, 20 bp, Artificial Sequence
  Synthetic polynucleotide
gttatgcacaataaaatagt

SEQ ID NO: 799 - DNA, 20 bp, Artificial Sequence
  Synthetic polynucleotide
aggtatctatgtatataagg

SEQ ID NO: 800 - DNA, 20 bp, Artificial Sequence
  Synthetic polynucleotide
gctcatccgtaatttaaagg

SEQ ID NO: 801 - DNA, 20 bp, Artificial Sequence
  Synthetic polynucleotide
atcacactacagtataacga

SEQ ID NO: 802 - DNA, 20 bp, Artificial Sequence
  Synthetic polynucleotide
tagaatctaagtattcacac

SEQ ID NO: 803 - DNA, 20 bp, Artificial Sequence
  Synthetic polynucleotide
gaaatccagtaagataacgg

SEQ ID NO: 804 - DNA, 20 bp, Artificial Sequence
  Synthetic polynucleotide
aatgttcatgcttcatattt

SEQ ID NO: 805 - DNA, 20 bp, Artificial Sequence
  Synthetic polynucleotide
acagcgcaagccactaattt

SEQ ID NO: 806 - DNA, 20 bp, Artificial Sequence
  Synthetic polynucleotide
attgaccggttctctaattt

SEQ ID NO: 807 - DNA, 20 bp, Artificial Sequence
  Synthetic polynucleotide
acctgtcgcagacctataaa

SEQ ID NO: 808 - DNA, 20 bp, Artificial Sequence
  Synthetic polynucleotide
tttctcccaaatacttataa

SEQ ID NO: 809 - DNA, 20 bp, Artificial Sequence
  Synthetic polynucleotide
tataggcaagatccctttac

SEQ ID NO: 810 - DNA, 20 bp, Artificial Sequence
  Synthetic polynucleotide
ttggtcctagcttacaatcg

SEQ ID NO: 811 - DNA, 20 bp, Artificial Sequence
  Synthetic polynucleotide
aagaaaccagaccctttatg

SEQ ID NO: 812 - DNA, 20 bp, Artificial Sequence
  Synthetic polynucleotide
aaccaactaaatacttcata

SEQ ID NO: 813 - DNA, 20 bp, Artificial Sequence
  Synthetic polynucleotide
cagtctcgagagaaccaata

SEQ ID NO: 814 - DNA, 20 bp, Artificial Sequence
  Synthetic polynucleotide
atagaacccctgatgctaat

SEQ ID NO: 815 - DNA, 20 bp, Artificial Sequence
  Synthetic polynucleotide
gtctgccacataaatacact

SEQ ID NO: 816 - DNA, 20 bp, Artificial Sequence
  Synthetic polynucleotide
tggatccattaattctccgt

SEQ ID NO: 817 - DNA, 20 bp, Artificial Sequence
  Synthetic polynucleotide
aaaccacaagtgaccaactt

SEQ ID NO: 818 - DNA, 20 bp, Artificial Sequence
  Synthetic polynucleotide
aacagccaaatttacacata

SEQ ID NO: 819 - DNA, 20 bp, Artificial Sequence
  Synthetic polynucleotide
ttaaggcacttgcctaaatt

SEQ ID NO: 820 - DNA, 20 bp, Artificial Sequence
  Synthetic polynucleotide
ggaagacatcttaataattg

SEQ ID NO: 821 - DNA, 20 bp, Artificial Sequence
  Synthetic polynucleotide
tgtgcccggtttcgtatatt

SEQ ID NO: 822 - DNA, 20 bp, Artificial Sequence
  Synthetic polynucleotide
tttgaccagctcgcttaatg

SEQ ID NO: 823 - DNA, 20 bp, Artificial Sequence
  Synthetic polynucleotide
ggtgtacgacgaaaatttag

SEQ ID NO: 824 - DNA, 20 bp, Artificial Sequence
  Synthetic polynucleotide
ggtaacctcaaatctatttg

SEQ ID NO: 825 - DNA, 20 bp, Artificial Sequence
  Synthetic polynucleotide
gcattcctatttagaagcaa

SEQ ID NO: 826 - DNA, 20 bp, Artificial Sequence
  Synthetic polynucleotide
taggtgcctgaactatagtt

SEQ ID NO: 827 - DNA, 20 bp, Artificial Sequence
  Synthetic polynucleotide
ttctctcatcccgcttggta

SEQ ID NO: 828 - DNA, 20 bp, Artificial Sequence
  Synthetic polynucleotide
gctgaccgattgtatataga

SEQ ID NO: 829 - DNA, 20 bp, Artificial Sequence
  Synthetic polynucleotide
taaatcctcagaaatatggc

SEQ ID NO: 830 - DNA, 20 bp, Artificial Sequence
  Synthetic polynucleotide
actaacctcctaaacgacag

SEQ ID NO: 831 - DNA, 20 bp, Artificial Sequence
  Synthetic polynucleotide
ttaagtctacaagcacacgg

SEQ ID NO: 832 - DNA, 20 bp, Artificial Sequence
  Synthetic polynucleotide
ctgcgacatgtgtatgtcaa

SEQ ID NO: 833 - DNA, 20 bp, Artificial Sequence
  Synthetic polynucleotide
gtatagctatcttgctacgg

SEQ ID NO: 834 - DNA, 20 bp, Artificial Sequence
  Synthetic polynucleotide
ccgcttcgatctgatattaa

SEQ ID NO: 835 - DNA, 20 bp, Artificial Sequence
  Synthetic polynucleotide
ccaagcctgttatctattac

SEQ ID NO: 836 - DNA, 20 bp, Artificial Sequence
  Synthetic polynucleotide
ttctacctttcagctaattg

SEQ ID NO: 837 - DNA, 20 bp, Artificial Sequence
  Synthetic polynucleotide
aggccactcaagacaatttg

SEQ ID NO: 838 - DNA, 20 bp, Artificial Sequence
  Synthetic polynucleotide
ttcgaccgttgcacacaaaa

SEQ ID NO: 839 - DNA, 20 bp, Artificial Sequence
  Synthetic polynucleotide
aaacgacccgcctcatttac

SEQ ID NO: 840 - DNA, 20 bp, Artificial Sequence
  Synthetic polynucleotide
tagaatcccgtcctttagca

SEQ ID NO: 841 - DNA, 20 bp, Artificial Sequence
  Synthetic polynucleotide
ccgcggccctttccccctta

SEQ ID NO: 842 - DNA, 20 bp, Artificial Sequence
  Synthetic polynucleotide
cccatcccgtgatgatccta

SEQ ID NO: 843 - DNA, 20 bp, Artificial Sequence
  Synthetic polynucleotide
tccgttcgagaaataccctc

SEQ ID NO: 844 - DNA, 20 bp, Artificial Sequence
  Synthetic polynucleotide
accattcactaaacctcgta

SEQ ID NO: 845 - DNA, 20 bp, Artificial Sequence
  Synthetic polynucleotide
cagtaccctgaaaaatctgg

SEQ ID NO: 846 - DNA, 20 bp, Artificial Sequence
  Synthetic polynucleotide
ccggcgcatcacataactga

SEQ ID NO: 847 - DNA, 20 bp, Artificial Sequence
  Synthetic polynucleotide
aacctccctgtgataccggc

SEQ ID NO: 848 - DNA, 20 bp, Artificial Sequence
  Synthetic polynucleotide
aacgccctaccgtacagaga

SEQ ID NO: 849 - DNA, 20 bp, Artificial Sequence
  Synthetic polynucleotide
gcccatccgctccctcgttt

SEQ ID NO: 850 - DNA, 20 bp, Artificial Sequence
  Synthetic polynucleotide
ccctaccgcaccgactttca

SEQ ID NO: 851 - DNA, 20 bp, Artificial Sequence
  Synthetic polynucleotide
tctctccacccgcagtcttt

SEQ ID NO: 852 - DNA, 20 bp, Artificial Sequence
  Synthetic polynucleotide
gacagtcaccgcaaaaatag

SEQ ID NO: 853 - DNA, 20 bp, Artificial Sequence
  Synthetic polynucleotide
acagccctcgaagtgaattt

SEQ ID NO: 854 - DNA, 20 bp, Artificial Sequence
  Synthetic polynucleotide
gaccgcctcaagcctttaaa

SEQ ID NO: 855 - DNA, 20 bp, Artificial Sequence
  Synthetic polynucleotide
ctcagccgagtagtcactaa

SEQ ID NO: 856 - DNA, 20 bp, Artificial Sequence
  Synthetic polynucleotide
gcccgtcccatccgccagtg

SEQ ID NO: 857 - DNA, 20 bp, Artificial Sequence
  Synthetic polynucleotide
ctgatgctttgaaattaccg

SEQ ID NO: 858 - DNA, 20 bp, Artificial Sequence
  Synthetic polynucleotide
ggcgagctcgagacgagaaa

SEQ ID NO: 859 - DNA, 20 bp, Artificial Sequence
  Synthetic polynucleotide
aactacccacgaccccccta

SEQ ID NO: 860 - DNA, 20 bp, Artificial Sequence
  Synthetic polynucleotide
cccagacctaacacttaggc

SEQ ID NO: 861 - DNA, 20 bp, Artificial Sequence
  Synthetic polynucleotide
cgtccacagtagaaacaggg

SEQ ID NO: 862 - DNA, 20 bp, Artificial Sequence
  Synthetic polynucleotide
gtcctgcgatacaccactgg

SEQ ID NO: 863 - DNA, 20 bp, Artificial Sequence
  Synthetic polynucleotide
gccctgctcagaattacggt

SEQ ID NO: 864 - DNA, 20 bp, Artificial Sequence
  Synthetic polynucleotide
atagctctatttgtctttct

SEQ ID NO: 865 - DNA, 20 bp, Artificial Sequence
  Synthetic polynucleotide
ttaaatctattacttagtta

SEQ ID NO: 866 - DNA, 20 bp, Artificial Sequence
  Synthetic polynucleotide
tttatactttaggcattaaa

SEQ ID NO: 867 - DNA, 20 bp, Artificial Sequence
  Synthetic polynucleotide
cttagacgtgtggacattac

SEQ ID NO: 868 - DNA, 20 bp, Artificial Sequence
  Synthetic polynucleotide
atttagccgtactttagttt

SEQ ID NO: 869 - DNA, 20 bp, Artificial Sequence
  Synthetic polynucleotide
tctctacacgaaattggttt

SEQ ID NO: 870 - DNA, 20 bp, Artificial Sequence
  Synthetic polynucleotide
tggtgtcaatgaaatagaat

SEQ ID NO: 871 - DNA, 20 bp, Artificial Sequence
  Synthetic polynucleotide
ccaatactcgggtttaagtt

SEQ ID NO: 872 - DNA, 20 bp, Artificial Sequence
  Synthetic polynucleotide
tatttcccttcatatctatc

SEQ ID NO: 873 - DNA, 20 bp, Artificial Sequence
  Synthetic polynucleotide
gatatgcgaagaagaataga

SEQ ID NO: 874 - DNA, 20 bp, Artificial Sequence
  Synthetic polynucleotide
taaacacaactcaccgtccg

SEQ ID NO: 875 - DNA, 20 bp, Artificial Sequence
  Synthetic polynucleotide
aaaaaccacaggaagttgac

SEQ ID NO: 876 - DNA, 20 bp, Artificial Sequence
  Synthetic polynucleotide
tatcaacataaccagaacag

SEQ ID NO: 877 - DNA, 20 bp, Artificial Sequence
  Synthetic polynucleotide
gacgtgcattggaaaaccat

SEQ ID NO: 878 - DNA, 20 bp, Artificial Sequence
  Synthetic polynucleotide
acttacctaaagagaacgaa

SEQ ID NO: 879 - DNA, 20 bp, Artificial Sequence
  Synthetic polynucleotide
ttaaatcacctggagtttca

SEQ ID NO: 880 - DNA, 20 bp, Artificial Sequence
  Synthetic polynucleotide
gtaattcaagtggctaaaaa

SEQ ID NO: 881 - DNA, 20 bp, Artificial Sequence
  Synthetic polynucleotide
cccagtccaattggataatt

SEQ ID NO: 882 - DNA, 20 bp, Artificial Sequence
  Synthetic polynucleotide
taaaaacgttatgatagttt

SEQ ID NO: 883 - DNA, 20 bp, Artificial Sequence
  Synthetic polynucleotide
acctcccctgtcggcttaat

SEQ ID NO: 884 - DNA, 20 bp, Artificial Sequence
  Synthetic polynucleotide
tacgcccataacgaatataa

SEQ ID NO: 885 - DNA, 20 bp, Artificial Sequence
  Synthetic polynucleotide
agttcacgtaactggagatt

SEQ ID NO: 886 - DNA, 20 bp, Artificial Sequence
  Synthetic polynucleotide
aaagatccgggataggagtt

SEQ ID NO: 887 - DNA, 20 bp, Artificial Sequence
  Synthetic polynucleotide
attattcgaaatccaatcca

SEQ ID NO: 888 - DNA, 20 bp, Artificial Sequence
  Synthetic polynucleotide
cggtttcaaattgactgcac

SEQ ID NO: 889 - DNA, 20 bp, Artificial Sequence
  Synthetic polynucleotide
atttaccaaaactcggtatc

SEQ ID NO: 890 - DNA, 20 bp, Artificial Sequence
  Synthetic polynucleotide
ggaagtcctacggtcaacag

SEQ ID NO: 891 - DNA, 20 bp, Artificial Sequence
  Synthetic polynucleotide
taggaacaagaatacggaac

SEQ ID NO: 892 - DNA, 20 bp, Artificial Sequence
  Synthetic polynucleotide
gaatgtctactgtaccaggc

SEQ ID NO: 893 - DNA, 20 bp, Artificial Sequence
  Synthetic polynucleotide
agttcacgaggataaaaccg

SEQ ID NO: 894 - DNA, 20 bp, Artificial Sequence
  Synthetic polynucleotide
agttgtctgcaagctaaatt

SEQ ID NO: 895 - DNA, 20 bp, Artificial Sequence
  Synthetic polynucleotide
cattccccttcggttatttg

SEQ ID NO: 896 - DNA, 20 bp, Artificial Sequence
  Synthetic polynucleotide
aatttgcccctaggctttct

SEQ ID NO: 897 - DNA, 20 bp, Artificial Sequence
  Synthetic polynucleotide
tgactcctcttacggtaaaa

SEQ ID NO: 898 - DNA, 20 bp, Artificial Sequence
  Synthetic polynucleotide
tccgagcaagtcggtttaca

SEQ ID NO: 899 - DNA, 20 bp, Artificial Sequence
  Synthetic polynucleotide
attagtcgcctaaggattta

SEQ ID NO: 900 - DNA, 20 bp, Artificial Sequence
  Synthetic polynucleotide
gtcccactcctacgattgat

SEQ ID NO: 901 - DNA, 20 bp, Artificial Sequence
  Synthetic polynucleotide
gagctccttcattaaggtaa

SEQ ID NO: 902 - DNA, 20 bp, Artificial Sequence
  Synthetic polynucleotide
actgtactgataatggtaaa

SEQ ID NO: 903 - DNA, 20 bp, Artificial Sequence
  Synthetic polynucleotide
attgatccttcaagagagag

SEQ ID NO: 904 - DNA, 20 bp, Artificial Sequence
  Synthetic polynucleotide
aagtccccatgtatgttgta

SEQ ID NO: 905 - DNA, 20 bp, Artificial Sequence
  Synthetic polynucleotide
tagcatccatggttgtcgtc

SEQ ID NO: 906 - DNA, 20 bp, Artificial Sequence
  Synthetic polynucleotide
atactcccatagagcatagc

SEQ ID NO: 907 - DNA, 20 bp, Artificial Sequence
  Synthetic polynucleotide
cttaaccaaagaatgacgac

SEQ ID NO: 908 - DNA, 20 bp, Artificial Sequence
  Synthetic polynucleotide
gagaaacgtacgaacaagta

SEQ ID NO: 909 - DNA, 20 bp, Artificial Sequence
  Synthetic polynucleotide
tctttacgtagcgggtttat

SEQ ID NO: 910 - DNA, 20 bp, Artificial Sequence
  Synthetic polynucleotide
cgctgccaccacggctttat

SEQ ID NO: 911 - DNA, 20 bp, Artificial Sequence
  Synthetic polynucleotide
ccactccgtgtggactttac

SEQ ID NO: 912 - DNA, 20 bp, Artificial Sequence
  Synthetic polynucleotide
attgatcataccttggtgct

SEQ ID NO: 913 - DNA, 20 bp, Artificial Sequence
  Synthetic polynucleotide
ccttgccgcgctatgcgatg

SEQ ID NO: 914 - DNA, 20 bp, Artificial Sequence
  Synthetic polynucleotide
cttagccattactgggtcct

SEQ ID NO: 915 - DNA, 20 bp, Artificial Sequence
  Synthetic polynucleotide
tatctccggatgcaagagca

SEQ ID NO: 916 - DNA, 20 bp, Artificial Sequence
  Synthetic polynucleotide
taatacctcacgagataaaa

SEQ ID NO: 917 - DNA, 20 bp, Artificial Sequence
  Synthetic polynucleotide
tttcgtcgttctacggtcca

SEQ ID NO: 918 - DNA, 20 bp, Artificial Sequence
  Synthetic polynucleotide
acatccccagttagtcagtc

SEQ ID NO: 919 - DNA, 20 bp, Artificial Sequence
  Synthetic polynucleotide
attaatccccgagccatcga

SEQ ID NO: 920 - DNA, 20 bp, Artificial Sequence
  Synthetic polynucleotide
gctgtgcccatcctaggagg

SEQ ID NO: 921 - DNA, 20 bp, Artificial Sequence
  Synthetic polynucleotide
cacgatcctctgagcacagc

SEQ ID NO: 922 - DNA, 20 bp, Artificial Sequence
  Synthetic polynucleotide
caatcccgatagacgaaaga

SEQ ID NO: 923 - DNA, 20 bp, Artificial Sequence
  Synthetic polynucleotide
aattaccggcttataaccgg

SEQ ID NO: 924 - DNA, 20 bp, Artificial Sequence
  Synthetic polynucleotide
cctgtgcacgcccagttgca

SEQ ID NO: 925 - DNA, 20 bp, Artificial Sequence
  Synthetic polynucleotide
catgaacttgtccgatttcc

SEQ ID NO: 926 - DNA, 20 bp, Artificial Sequence
  Synthetic polynucleotide
cgttgccgccccggaatttg

SEQ ID NO: 927 - DNA, 20 bp, Artificial Sequence
  Synthetic polynucleotide
gccacgcgaagtcagctgct

SEQ ID NO: 928 - DNA, 20 bp, Artificial Sequence
  Synthetic polynucleotide
ggttgacgccctaggtcact

SEQ ID NO: 929 - DNA, 20 bp, Artificial Sequence
  Synthetic polynucleotide
ccacaccactggggaagtat

SEQ ID NO: 930 - DNA, 20 bp, Artificial Sequence
  Synthetic polynucleotide
tctcgcccttgcgagttcga

SEQ ID NO: 931 - DNA, 20 bp, Artificial Sequence
  Synthetic polynucleotide
cgagcgcgcaaccgctcctc

SEQ ID NO: 932 - DNA, 20 bp, Artificial Sequence
  Synthetic polynucleotide
agccaacccacagcgtaaag

SEQ ID NO: 933 - DNA, 20 bp, Artificial Sequence
  Synthetic polynucleotide
gtcctacctccagatgggaa

SEQ ID NO: 934 - DNA, 20 bp, Artificial Sequence
  Synthetic polynucleotide
tgcgcacttgtcagatccag

SEQ ID NO: 935 - DNA, 20 bp, Artificial Sequence
  Synthetic polynucleotide
agagccctaggaacacccta

SEQ ID NO: 936 - DNA, 20 bp, Artificial Sequence
  Synthetic polynucleotide
ggctcacacacattccgtgc

SEQ ID NO: 937 - DNA, 20 bp, Artificial Sequence
  Synthetic polynucleotide
gtaacgccttaccgctgtgg

SEQ ID NO: 938 - DNA, 20 bp, Artificial Sequence
  Synthetic polynucleotide
catcatcttctcgtccgggc

SEQ ID NO: 939 - DNA, 20 bp, Artificial Sequence
  Synthetic polynucleotide
atcaaccattaaactcttct

SEQ ID NO: 940 - DNA, 20 bp, Artificial Sequence
  Synthetic polynucleotide
tcttccctttgtgataaatg

SEQ ID NO: 941 - DNA, 20 bp, Artificial Sequence
  Synthetic polynucleotide
tcttaccatggcatttaata

SEQ ID NO: 942 - DNA, 20 bp, Artificial Sequence
  Synthetic polynucleotide
aatttacaactatgggatat

SEQ ID NO: 943 - DNA, 20 bp, Artificial Sequence
  Synthetic polynucleotide
atataccagatttggagatt

SEQ ID NO: 944 - DNA, 20 bp, Artificial Sequence
  Synthetic polynucleotide
ataatacgcggttatggtta

SEQ ID NO: 945 - DNA, 20 bp, Artificial Sequence
  Synthetic polynucleotide
cgctagcatcatatggataa

SEQ ID NO: 946 - DNA, 20 bp, Artificial Sequence
  Synthetic polynucleotide
ttggttccaagatattacct

SEQ ID NO: 947 - DNA, 20 bp, Artificial Sequence
  Synthetic polynucleotide
taagtacctatattaggttc

SEQ ID NO: 948 - DNA, 20 bp, Artificial Sequence
  Synthetic polynucleotide
tatcgtcgaattagagcaag

SEQ ID NO: 949 - DNA, 20 bp, Artificial Sequence
  Synthetic polynucleotide
acgatacataggtatcaagt

SEQ ID NO: 950 - DNA, 20 bp, Artificial Sequence
  Synthetic polynucleotide
agtgaactagatacttcatt

SEQ ID NO: 951 - DNA, 20 bp, Artificial Sequence
  Synthetic polynucleotide
tatcaccggagttaaagtgg

SEQ ID NO: 952 - DNA, 20 bp, Artificial Sequence
  Synthetic polynucleotide
atatggcaggatgcaccagc

SEQ ID NO: 953 - DNA, 20 bp, Artificial Sequence
  Synthetic polynucleotide
tgactacttgtgaatcatga

SEQ ID NO: 954 - DNA, 20 bp, Artificial Sequence
  Synthetic polynucleotide
catatgctcttgtgctttct

SEQ ID NO: 955 - DNA, 20 bp, Artificial Sequence
  Synthetic polynucleotide
tcttccctggctatggttct

SEQ ID NO: 956 - DNA, 20 bp, Artificial Sequence
  Synthetic polynucleotide
gatatacgtcttccatttcc

SEQ ID NO: 957 - DNA, 20 bp, Artificial Sequence
  Synthetic polynucleotide
taaaagctttcgatttattt

SEQ ID NO: 958 - DNA, 20 bp, Artificial Sequence
  Synthetic polynucleotide
atggatccgtttaggtatat

SEQ ID NO: 959 - DNA, 20 bp, Artificial Sequence
  Synthetic polynucleotide
aaaagtctggtttgtcatca

SEQ ID NO: 960 - DNA, 20 bp, Artificial Sequence
  Synthetic polynucleotide
acatgtcccagacgtatacc

SEQ ID NO: 961 - DNA, 20 bp, Artificial Sequence
  Synthetic polynucleotide
aagcttcagctagagttagt

SEQ ID NO: 962 - DNA, 20 bp, Artificial Sequence
  Synthetic polynucleotide
aatatacaatcagttagata

SEQ ID NO: 963 - DNA, 20 bp, Artificial Sequence
  Synthetic polynucleotide
ttcacgctaaaacagacctc

SEQ ID NO: 964 - DNA, 20 bp, Artificial Sequence
  Synthetic polynucleotide
ttaggtcaacagctgtccta

SEQ ID NO: 965 - DNA, 20 bp, Artificial Sequence
  Synthetic polynucleotide
tcaaacccaaagattgttgt

SEQ ID NO: 966 - DNA, 20 bp, Artificial Sequence
  Synthetic polynucleotide
tatggcccgtatggcaaggc

SEQ ID NO: 967 - DNA, 20 bp, Artificial Sequence
  Synthetic polynucleotide
atccaacggtaactaaccac

SEQ ID NO: 968 - DNA, 20 bp, Artificial Sequence
  Synthetic polynucleotide
gatcaccttcagagtgtcag

SEQ ID NO: 969 - DNA, 20 bp, Artificial Sequence
  Synthetic polynucleotide
tacaatcgccctactcttct

SEQ ID NO: 970 - DNA, 20 bp, Artificial Sequence
  Synthetic polynucleotide
acatcgcagcggtctaattt

SEQ ID NO: 971 - DNA, 20 bp, Artificial Sequence
  Synthetic polynucleotide
ttcgtgcacttaggtatttc

SEQ ID NO: 972 - DNA, 20 bp, Artificial Sequence
  Synthetic polynucleotide
gtatctcgtagagatttaag

SEQ ID NO: 973 - DNA, 20 bp, Artificial Sequence
  Synthetic polynucleotide
ccgcctcaattacctggtct

SEQ ID NO: 974 - DNA, 20 bp, Artificial Sequence
  Synthetic polynucleotide
ggacgcccgagtttggttta

SEQ ID NO: 975 - DNA, 20 bp, Artificial Sequence
  Synthetic polynucleotide
ccttcgcttaacccggtgcc

SEQ ID NO: 976 - DNA, 20 bp, Artificial Sequence
  Synthetic polynucleotide
gagttccttcagctctatca

SEQ ID NO: 977 - DNA, 20 bp, Artificial Sequence
  Synthetic polynucleotide
tcatgccatgcgtaatcatc

SEQ ID NO: 978 - DNA, 20 bp, Artificial Sequence
  Synthetic polynucleotide
ccgctgcaagataggaacgt

SEQ ID NO: 979 - DNA, 20 bp, Artificial Sequence
  Synthetic polynucleotide
tcagagcgaacatagacgat

SEQ ID NO: 980 - DNA, 20 bp, Artificial Sequence
  Synthetic polynucleotide
ggtcatcgtgatacacagca

SEQ ID NO: 981 - DNA, 20 bp, Artificial Sequence
  Synthetic polynucleotide
gacccacattaccttacgta

SEQ ID NO: 982 - DNA, 20 bp, Artificial Sequence
  Synthetic polynucleotide
gaccaacggataacatgaga

SEQ ID NO: 983 - DNA, 20 bp, Artificial Sequence
  Synthetic polynucleotide
tctccccaggaaagatcagg

SEQ ID NO: 984 - DNA, 20 bp, Artificial Sequence
  Synthetic polynucleotide
gtgcctccggcttattatta

SEQ ID NO: 985 - DNA, 20 bp, Artificial Sequence
  Synthetic polynucleotide
tcccagctccgtcttcttct

SEQ ID NO: 986 - DNA, 20 bp, Artificial Sequence
  Synthetic polynucleotide
tctcatctccgtggctttaa

SEQ ID NO: 987 - DNA, 20 bp, Artificial Sequence
  Synthetic polynucleotide
actcatcatccggttaaacg

SEQ ID NO: 988 - DNA, 20 bp, Artificial Sequence
  Synthetic polynucleotide
ggtctccagttgtcttactt

SEQ ID NO: 989 - DNA, 20 bp, Artificial Sequence
  Synthetic polynucleotide
taggaccgcccagactatct

SEQ ID NO: 990 - DNA, 20 bp, Artificial Sequence
  Synthetic polynucleotide
gtcatgcgcattggaactat

SEQ ID NO: 991 - DNA, 20 bp, Artificial Sequence
  Synthetic polynucleotide
gacatccaaagtttgcgtcc

SEQ ID NO: 992 - DNA, 20 bp, Artificial Sequence
  Synthetic polynucleotide
cctggccctccggagatgta

SEQ ID NO: 993 - DNA, 20 bp, Artificial Sequence
  Synthetic polynucleotide
agaccgccgttaagtgccat

SEQ ID NO: 994 - DNA, 20 bp, Artificial Sequence
  Synthetic polynucleotide
ttgcgccctaatacgaccct

SEQ ID NO: 995 - DNA, 20 bp, Artificial Sequence
  Synthetic polynucleotide
catctccgcctccatggagc

SEQ ID NO: 996 - DNA, 20 bp, Artificial Sequence
  Synthetic polynucleotide
tcctaccatctaagcgatgg

SEQ ID NO: 997 - DNA, 20 bp, Artificial Sequence
  Synthetic polynucleotide
taagcacctatcgaccccga

SEQ ID NO: 998 - DNA, 20 bp, Artificial Sequence
  Synthetic polynucleotide
gaatcgctgatctgcaacac

SEQ ID NO: 999 - DNA, 20 bp, Artificial Sequence
  Synthetic polynucleotide
ctatagcacccgggaattca

SEQ ID NO: 1000 - DNA, 20 bp, Artificial Sequence
  Synthetic polynucleotide
gcttccccgtctgctgatct

SEQ ID NO: 1001 - DNA, 20 bp, Artificial Sequence
  Synthetic polynucleotide
gcggtccgactcttagttct

SEQ ID NO: 1002 - DNA, 20 bp, Artificial Sequence
  Synthetic polynucleotide
ctatcgcaccctgttgaatg

SEQ ID NO: 1003 - DNA, 20 bp, Artificial Sequence
  Synthetic polynucleotide
ttagtcccccagggctttag

SEQ ID NO: 1004 - DNA, 20 bp, Artificial Sequence
  Synthetic polynucleotide
ggcgcccggacgagtcttac

SEQ ID NO: 1005 - DNA, 20 bp, Artificial Sequence
  Synthetic polynucleotide
gcacccctcatcgctgctgc

SEQ ID NO: 1006 - DNA, 20 bp, Artificial Sequence
  Synthetic polynucleotide
gtgtcgccggtctacattac

SEQ ID NO: 1007 - DNA, 20 bp, Artificial Sequence
  Synthetic polynucleotide
ggttgaccgcaatgccaaat

SEQ ID NO: 1008 - DNA, 20 bp, Artificial Sequence
  Synthetic polynucleotide
atcggccttccaaagacgaa

SEQ ID NO: 1009 - DNA, 20 bp, Artificial Sequence
  Synthetic polynucleotide
caacgtctcttaccatgcgc

SEQ ID NO: 1010 - DNA, 20 bp, Artificial Sequence
  Synthetic polynucleotide
tttgcacggtacaatggcat

SEQ ID NO: 1011 - DNA, 20 bp, Artificial Sequence
  Synthetic polynucleotide
attgctcgagaactgacatc

SEQ ID NO: 1012 - DNA, 20 bp, Artificial Sequence
  Synthetic polynucleotide
ccttctccccaacggacgta

SEQ ID NO: 1013 - DNA, 20 bp, Artificial Sequence
  Synthetic polynucleotide
gttccacctatcagacacag

SEQ ID NO: 1014 - DNA, 20 bp, Artificial Sequence
  Synthetic polynucleotide
actaaaccgttattgtttcg

SEQ ID NO: 1015 - DNA, 20 bp, Artificial Sequence
  Synthetic polynucleotide
aattgtctttaatctattat

SEQ ID NO: 1016 - DNA, 20 bp, Artificial Sequence
  Synthetic polynucleotide
gcttggcgatgattaattat

SEQ ID NO: 1017 - DNA, 20 bp, Artificial Sequence
  Synthetic polynucleotide
agaaatcagttcacttaatc

SEQ ID NO: 1018 - DNA, 20 bp, Artificial Sequence
  Synthetic polynucleotide
aactttcataatccttatct

SEQ ID NO: 1019 - DNA, 20 bp, Artificial Sequence
  Synthetic polynucleotide
aaatcgcatggcataaatat

SEQ ID NO: 1020 - DNA, 20 bp, Artificial Sequence
  Synthetic polynucleotide
taatagcaatgtatgaaaaa

SEQ ID NO: 1021 - DNA, 20 bp, Artificial Sequence
  Synthetic polynucleotide
ttataccttaaaaagtctca

SEQ ID NO: 1022 - DNA, 20 bp, Artificial Sequence
  Synthetic polynucleotide
cactatcaacaatgattaat

SEQ ID NO: 1023 - DNA, 20 bp, Artificial Sequence
  Synthetic polynucleotide
attacacctgattgatttgt

SEQ ID NO: 1024 - DNA, 20 bp, Artificial Sequence
  Synthetic polynucleotide
acacctcgaatgaatcgaat

SEQ ID NO: 1025 - DNA, 20 bp, Artificial Sequence
  Synthetic polynucleotide
ttattgcggatattgataga

SEQ ID NO: 1026 - DNA, 20 bp, Artificial Sequence
  Synthetic polynucleotide
ttaccactaaacattgcagc

SEQ ID NO: 1027 - DNA, 20 bp, Artificial Sequence
  Synthetic polynucleotide
catgttcaacaaaccgacaa

SEQ ID NO: 1028 - DNA, 20 bp, Artificial Sequence
  Synthetic polynucleotide
aaaagtcaaatgcaaacgag

SEQ ID NO: 1029 - DNA, 20 bp, Artificial Sequence
  Synthetic polynucleotide
ttgagtctgtcgatttattt

SEQ ID NO: 1030 - DNA, 20 bp, Artificial Sequence
  Synthetic polynucleotide
agagccccacctgattattt

SEQ ID NO: 1031 - DNA, 20 bp, Artificial Sequence
  Synthetic polynucleotide
tggtcgcaattacattaatt

SEQ ID NO: 1032 - DNA, 20 bp, Artificial Sequence
  Synthetic polynucleotide
acgactctcgagaagtattt

SEQ ID NO: 1033 - DNA, 20 bp, Artificial Sequence
  Synthetic polynucleotide
tctggacagacatcatatat

SEQ ID NO: 1034 - DNA, 20 bp, Artificial Sequence
  Synthetic polynucleotide
attcttcttgggtgctcttt

SEQ ID NO: 1035 - DNA, 20 bp, Artificial Sequence
  Synthetic polynucleotide
agaacacatgctgtctgttg

SEQ ID NO: 1036 - DNA, 20 bp, Artificial Sequence
  Synthetic polynucleotide
tttatactgtgaagtcagta

SEQ ID NO: 1037 - DNA, 20 bp, Artificial Sequence
  Synthetic polynucleotide
catatgcgcctgcgaaagca

SEQ ID NO: 1038 - DNA, 20 bp, Artificial Sequence
  Synthetic polynucleotide
atcgacctaatcgacagcaa

SEQ ID NO: 1039 - DNA, 20 bp, Artificial Sequence
  Synthetic polynucleotide
ttgatactagactgacgatc

SEQ ID NO: 1040 - DNA, 20 bp, Artificial Sequence
  Synthetic polynucleotide
ttatggcaacattcagcata

SEQ ID NO: 1041 - DNA, 20 bp, Artificial Sequence
  Synthetic polynucleotide
tatatgcgaggtgacaacac

SEQ ID NO: 1042 - DNA, 20 bp, Artificial Sequence
  Synthetic polynucleotide
atatgtccctagaccgtagg

SEQ ID NO: 1043 - DNA, 20 bp, Artificial Sequence
  Synthetic polynucleotide
ctaagacgaggttagatcgg

SEQ ID NO: 1044 - DNA, 20 bp, Artificial Sequence
  Synthetic polynucleotide
gtatatcacgatggataaat

SEQ ID NO: 1045 - DNA, 20 bp, Artificial Sequence
  Synthetic polynucleotide
atatctcgcggtcgtaaatg

SEQ ID NO: 1046 - DNA, 20 bp, Artificial Sequence
  Synthetic polynucleotide
tctgaactctctactattct

SEQ ID NO: 1047 - DNA, 20 bp, Artificial Sequence
  Synthetic polynucleotide
tgcgcccgaacttagtaact

SEQ ID NO: 1048 - DNA, 20 bp, Artificial Sequence
  Synthetic polynucleotide
tcatcacactctctgttctt

SEQ ID NO: 1049 - DNA, 20 bp, Artificial Sequence
  Synthetic polynucleotide
cctcggcctgatagttatct

SEQ ID NO: 1050 - DNA, 20 bp, Artificial Sequence
  Synthetic polynucleotide
ttccagcaaaaagtacagca

SEQ ID NO: 1051 - DNA, 20 bp, Artificial Sequence
  Synthetic polynucleotide
acacttcaatttgctatggc

SEQ ID NO: 1052 - DNA, 20 bp, Artificial Sequence
  Synthetic polynucleotide
ttagcccaacgaatcggtcc

SEQ ID NO: 1053 - DNA, 20 bp, Artificial Sequence
  Synthetic polynucleotide
ctttcacgtcaggtgaggta

SEQ ID NO: 1054 - DNA, 20 bp, Artificial Sequence
  Synthetic polynucleotide
actgatccgaggtcatctgt

SEQ ID NO: 1055 - DNA, 20 bp, Artificial Sequence
  Synthetic polynucleotide
tacagaccgtataggtctga

SEQ ID NO: 1056 - DNA, 20 bp, Artificial Sequence
  Synthetic polynucleotide
tacatacaagggatttcagg

SEQ ID NO: 1057 - DNA, 20 bp, Artificial Sequence
  Synthetic polynucleotide
taacgtcatgagtagagggc

SEQ ID NO: 1058 - DNA, 20 bp, Artificial Sequence
  Synthetic polynucleotide
tagcttcacaactgaccgat

SEQ ID NO: 1059 - DNA, 20 bp, Artificial Sequence
  Synthetic polynucleotide
acaatgctgtcgtttcatct

SEQ ID NO: 1060 - DNA, 20 bp, Artificial Sequence
  Synthetic polynucleotide
cactgccggcgtccataatc

SEQ ID NO: 1061 - DNA, 20 bp, Artificial Sequence
  Synthetic polynucleotide
tatctactaacctggtttcg

SEQ ID NO: 1062 - DNA, 20 bp, Artificial Sequence
  Synthetic polynucleotide
ctatgtctgttcctctagct

SEQ ID NO: 1063 - DNA, 20 bp, Artificial Sequence
  Synthetic polynucleotide
gttgaccctcttgttgtttc

SEQ ID NO: 1064 - DNA, 20 bp, Artificial Sequence
  Synthetic polynucleotide
cttgctcatggtgcgagcct

SEQ ID NO: 1065 - DNA, 20 bp, Artificial Sequence
  Synthetic polynucleotide
cagttgcgtccggcagtaaa

SEQ ID NO: 1066 - DNA, 20 bp, Artificial Sequence
  Synthetic polynucleotide
gcacagccttcaatttggcc

SEQ ID NO: 1067 - DNA, 20 bp, Artificial Sequence
  Synthetic polynucleotide
acgacccggtcaggtgactc

SEQ ID NO: 1068 - DNA, 20 bp, Artificial Sequence
  Synthetic polynucleotide
tgaggacaaaaagaaggaac

SEQ ID NO: 1069 - DNA, 20 bp, Artificial Sequence
  Synthetic polynucleotide
tgctgacattgagctaccct

SEQ ID NO: 1070 - DNA, 20 bp, Artificial Sequence
  Synthetic polynucleotide
tgagaccctttcggcgatgc

SEQ ID NO: 1071 - DNA, 20 bp, Artificial Sequence
  Synthetic polynucleotide
gtcatccgatacttccgaga

SEQ ID NO: 1072 - DNA, 20 bp, Artificial Sequence
  Synthetic polynucleotide
aacgatcagaagaccgagta

SEQ ID NO: 1073 - DNA, 20 bp, Artificial Sequence
  Synthetic polynucleotide
agaaggctcaagatcccgaa

SEQ ID NO: 1074 - DNA, 20 bp, Artificial Sequence
  Synthetic polynucleotide
cggcccctgacgggttgttt

SEQ ID NO: 1075 - DNA, 20 bp, Artificial Sequence
  Synthetic polynucleotide
tcgtcgccccactcatttca

SEQ ID NO: 1076 - DNA, 20 bp, Artificial Sequence
  Synthetic polynucleotide
ccgggtcggaatcctcttat

SEQ ID NO: 1077 - DNA, 20 bp, Artificial Sequence
  Synthetic polynucleotide
gaggagcagcgacaggattt

SEQ ID NO: 1078 - DNA, 20 bp, Artificial Sequence
  Synthetic polynucleotide
cactaacccagggtctctat

SEQ ID NO: 1079 - DNA, 20 bp, Artificial Sequence
  Synthetic polynucleotide
tgacgtccccttggcttatg

SEQ ID NO: 1080 - DNA, 20 bp, Artificial Sequence
  Synthetic polynucleotide
acggtccctgttccagcgtt

SEQ ID NO: 1081 - DNA, 20 bp, Artificial Sequence
  Synthetic polynucleotide
cgccctccgctagcagcgac

SEQ ID NO: 1082 - DNA, 20 bp, Artificial Sequence
  Synthetic polynucleotide
gctcagcctattaggtcccg

SEQ ID NO: 1083 - DNA, 20 bp, Artificial Sequence
  Synthetic polynucleotide
accccccaagtcgaatacat

SEQ ID NO: 1084 - DNA, 20 bp, Artificial Sequence
  Synthetic polynucleotide
gtacatcgcaagtccctgaa

SEQ ID NO: 1085 - DNA, 20 bp, Artificial Sequence
  Synthetic polynucleotide
accgcgcccacaaaaatcgc

SEQ ID NO: 1086 - DNA, 20 bp, Artificial Sequence
  Synthetic polynucleotide
aacaacccccagaacgtcgg

SEQ ID NO: 1087 - DNA, 20 bp, Artificial Sequence
  Synthetic polynucleotide
gaccgcctatcgtgcaccgg

SEQ ID NO: 1088 - DNA, 20 bp, Artificial Sequence
  Synthetic polynucleotide
tagtacccccacttgacatt

SEQ ID NO: 1089 - DNA, 20 bp, Artificial Sequence
  Synthetic polynucleotide
gtattgcagtcaaataaatt

SEQ ID NO: 1090 - DNA, 20 bp, Artificial Sequence
  Synthetic polynucleotide
caccggcttgttaaataatt

SEQ ID NO: 1091 - DNA, 20 bp, Artificial Sequence
  Synthetic polynucleotide
tccatacttacgtaataatt

SEQ ID NO: 1092 - DNA, 20 bp, Artificial Sequence
  Synthetic polynucleotide
tgtactcaccttgatagtaa

SEQ ID NO: 1093 - DNA, 20 bp, Artificial Sequence
  Synthetic polynucleotide
acttatctcggagtcatatt

SEQ ID NO: 1094 - DNA, 20 bp, Artificial Sequence
  Synthetic polynucleotide
gaaattccccttagatgttt

SEQ ID NO: 1095 - DNA, 20 bp, Artificial Sequence
  Synthetic polynucleotide
acatgacatgctaatagatc

SEQ ID NO: 1096 - DNA, 20 bp, Artificial Sequence
  Synthetic polynucleotide
aggacacatctcagaaaatc

SEQ ID NO: 1097 - DNA, 20 bp, Artificial Sequence
  Synthetic polynucleotide
agttgtcgctcgataatata

SEQ ID NO: 1098 - DNA, 20 bp, Artificial Sequence
  Synthetic polynucleotide
ttctaccataagtccgccac

SEQ ID NO: 1099 - DNA, 20 bp, Artificial Sequence
  Synthetic polynucleotide
acagtacgatcttaaaggta

SEQ ID NO: 1100 - DNA, 20 bp, Artificial Sequence
  Synthetic polynucleotide
ttggatcattcaagaaaagg

SEQ ID NO: 1101 - DNA, 20 bp, Artificial Sequence
  Synthetic polynucleotide
gtatatcatatgttcagggg

SEQ ID NO: 1102 - DNA, 20 bp, Artificial Sequence
  Synthetic polynucleotide
ttctggctgataagcatgac

SEQ ID NO: 1103 - DNA, 20 bp, Artificial Sequence
  Synthetic polynucleotide
aacagtctttaaaaatgagg

SEQ ID NO: 1104 - DNA, 20 bp, Artificial Sequence
  Synthetic polynucleotide
tttcaccgtggctcataatt

SEQ ID NO: 1105 - DNA, 20 bp, Artificial Sequence
  Synthetic polynucleotide
cgctttctgtttcatattct

SEQ ID NO: 1106 - DNA, 20 bp, Artificial Sequence
  Synthetic polynucleotide
cacattcgtaaggattattt

SEQ ID NO: 1107 - DNA, 20 bp, Artificial Sequence
  Synthetic polynucleotide
ttagttcctagcgagtctct

SEQ ID NO: 1108 - DNA, 20 bp, Artificial Sequence
  Synthetic polynucleotide
ccaattcgttggacttatct

SEQ ID NO: 1109 - DNA, 20 bp, Artificial Sequence
  Synthetic polynucleotide
ttgttactttatcctttgca

SEQ ID NO: 1110 - DNA, 20 bp, Artificial Sequence
  Synthetic polynucleotide
ttgtttctagttcgctgata

SEQ ID NO: 1111 - DNA, 20 bp, Artificial Sequence
  Synthetic polynucleotide
gttctacagattgcttgtac

SEQ ID NO: 1112 - DNA, 20 bp, Artificial Sequence
  Synthetic polynucleotide
cacaatctgagtggcaatac

SEQ ID NO: 1113 - DNA, 20 bp, Artificial Sequence
  Synthetic polynucleotide
aacaggctttctccaactgc

SEQ ID NO: 1114 - DNA, 20 bp, Artificial Sequence
  Synthetic polynucleotide
cttatgcttctaataagcgt

SEQ ID NO: 1115 - DNA, 20 bp, Artificial Sequence
  Synthetic polynucleotide
atttgccgagcataagaaca

SEQ ID NO: 1116 - DNA, 20 bp, Artificial Sequence
  Synthetic polynucleotide
agccctcgataatacaggta

SEQ ID NO: 1117 - DNA, 20 bp, Artificial Sequence
  Synthetic polynucleotide
tagaccccttcaagtaacgt

SEQ ID NO: 1118 - DNA, 20 bp, Artificial Sequence
  Synthetic polynucleotide
agactccagacctatcctgc

SEQ ID NO: 1119 - DNA, 20 bp, Artificial Sequence
  Synthetic polynucleotide
ggaaccctggggtttattct

SEQ ID NO: 1120 - DNA, 20 bp, Artificial Sequence
  Synthetic polynucleotide
tcaagcctgcgctaatttac

SEQ ID NO: 1121 - DNA, 20 bp, Artificial Sequence
  Synthetic polynucleotide
actcaccctctgcgttattg

SEQ ID NO: 1122 - DNA, 20 bp, Artificial Sequence
  Synthetic polynucleotide
tagagtcatatgcgtgttat

SEQ ID NO: 1123 - DNA, 20 bp, Artificial Sequence
  Synthetic polynucleotide
ctggcgcagcatagaattat

SEQ ID NO: 1124 - DNA, 20 bp, Artificial Sequence
  Synthetic polynucleotide
tgagatcacggtacgtttaa

SEQ ID NO: 1125 - DNA, 20 bp, Artificial Sequence
  Synthetic polynucleotide
taaaaccaggcccgaataga

SEQ ID NO: 1126 - DNA, 20 bp, Artificial Sequence
  Synthetic polynucleotide
tatgggccatgtagtatcat

SEQ ID NO: 1127 - DNA, 20 bp, Artificial Sequence
  Synthetic polynucleotide
cccgtgcttgataaagtaaa

SEQ ID NO: 1128 - DNA, 20 bp, Artificial Sequence
  Synthetic polynucleotide
atctttctttgtagcaaaga

SEQ ID NO: 1129 - DNA, 20 bp, Artificial Sequence
  Synthetic polynucleotide
tattagcagaagtaagcgct

SEQ ID NO: 1130 - DNA, 20 bp, Artificial Sequence
  Synthetic polynucleotide
atgacccatacgtcacagag

SEQ ID NO: 1131 - DNA, 20 bp, Artificial Sequence
  Synthetic polynucleotide
gctacacggaatggaacgta

SEQ ID NO: 1132 - DNA, 20 bp, Artificial Sequence
  Synthetic polynucleotide
atgacgcactgaatcgtaga

SEQ ID NO: 1133 - DNA, 20 bp, Artificial Sequence
  Synthetic polynucleotide
tgagttcttcaataccgtgg

SEQ ID NO: 1134 - DNA, 20 bp, Artificial Sequence
  Synthetic polynucleotide
gccgcccacgttatgcttct

SEQ ID NO: 1135 - DNA, 20 bp, Artificial Sequence
  Synthetic polynucleotide
ctgtctcggtttacctttcc

SEQ ID NO: 1136 - DNA, 20 bp, Artificial Sequence
  Synthetic polynucleotide
agtggccgccttgctttcta

SEQ ID NO: 1137 - DNA, 20 bp, Artificial Sequence
  Synthetic polynucleotide
tgacagccctgcaggagttg

SEQ ID NO: 1138 - DNA, 20 bp, Artificial Sequence
  Synthetic polynucleotide
tatagcccgctacatgaaac

SEQ ID NO: 1139 - DNA, 20 bp, Artificial Sequence
  Synthetic polynucleotide
ccgacccagtgttgtactct

SEQ ID NO: 1140 - DNA, 20 bp, Artificial Sequence
  Synthetic polynucleotide
ttattacagggatgttacta

SEQ ID NO: 1141 - DNA, 20 bp, Artificial Sequence
  Synthetic polynucleotide
gcaatgcaccattagcaccc

SEQ ID NO: 1142 - DNA, 20 bp, Artificial Sequence
  Synthetic polynucleotide
aggtccccgccagatatgaa

SEQ ID NO: 1143 - DNA, 20 bp, Artificial Sequence
  Synthetic polynucleotide
aatgttctaaagaaccgcag

SEQ ID NO: 1144 - DNA, 20 bp, Artificial Sequence
  Synthetic polynucleotide
aacaagcatccgacaaaccc

SEQ ID NO: 1145 - DNA, 20 bp, Artificial Sequence
  Synthetic polynucleotide
tgtagcccttagtatgtaac

SEQ ID NO: 1146 - DNA, 20 bp, Artificial Sequence
  Synthetic polynucleotide
aacgtaccatcatagagagg

SEQ ID NO: 1147 - DNA, 20 bp, Artificial Sequence
  Synthetic polynucleotide
ggatctccgatatagcgaga

SEQ ID NO: 1148 - DNA, 20 bp, Artificial Sequence
  Synthetic polynucleotide
acatgaccggtctaacgaga

SEQ ID NO: 1149 - DNA, 20 bp, Artificial Sequence
  Synthetic polynucleotide
ccctgcccccccgatgtttc

SEQ ID NO: 1150 - DNA, 20 bp, Artificial Sequence
  Synthetic polynucleotide
ggcagtcctggggagattct

SEQ ID NO: 1151 - DNA, 20 bp, Artificial Sequence
  Synthetic polynucleotide
gcgctacggcctctatttcg

SEQ ID NO: 1152 - DNA, 20 bp, Artificial Sequence
  Synthetic polynucleotide
cgcttcccggatacagtttg

SEQ ID NO: 1153 - DNA, 20 bp, Artificial Sequence
  Synthetic polynucleotide
gacgagcggggacggactct

SEQ ID NO: 1154 - DNA, 20 bp, Artificial Sequence
  Synthetic polynucleotide
ggccccctgtcacatcgctt

SEQ ID NO: 1155 - DNA, 20 bp, Artificial Sequence
  Synthetic polynucleotide
atccaactgtggaccatatg

SEQ ID NO: 1156 - DNA, 20 bp, Artificial Sequence
  Synthetic polynucleotide
cccttcccccccggcgagtt

SEQ ID NO: 1157 - DNA, 20 bp, Artificial Sequence
  Synthetic polynucleotide
cgagagcctgagcaataccg

SEQ ID NO: 1158 - DNA, 20 bp, Artificial Sequence
  Synthetic polynucleotide
ctcagtctatagcccccgcg

SEQ ID NO: 1159 - DNA, 20 bp, Artificial Sequence
  Synthetic polynucleotide
catcaacgaagtagaacata

SEQ ID NO: 1160 - DNA, 20 bp, Artificial Sequence
  Synthetic polynucleotide
ctgcccctggaacaccatga

SEQ ID NO: 1161 - DNA, 20 bp, Artificial Sequence
  Synthetic polynucleotide
tacgcgcgaggaccctgtga

SEQ ID NO: 1162 - DNA, 20 bp, Artificial Sequence
  Synthetic polynucleotide
cgccgacgctatcttatggc

SEQ ID NO: 1163 - DNA, 20 bp, Artificial Sequence
  Synthetic polynucleotide
ggactaccaatgttagacgc

SEQ ID NO: 1164 - DNA, 20 bp, Artificial Sequence
  Synthetic polynucleotide
atatttcggagcgttaaatc

SEQ ID NO: 1165 - DNA, 20 bp, Artificial Sequence
  Synthetic polynucleotide
gtatttctatactaatttat

SEQ ID NO: 1166 - DNA, 20 bp, Artificial Sequence
  Synthetic polynucleotide
atatttctgatcaataattt

SEQ ID NO: 1167 - DNA, 20 bp, Artificial Sequence
  Synthetic polynucleotide
aatatccctgtgattgattt

SEQ ID NO: 1168 - DNA, 20 bp, Artificial Sequence
  Synthetic polynucleotide
ggcgaacgacgtgaaaaata

SEQ ID NO: 1169 - DNA, 20 bp, Artificial Sequence
  Synthetic polynucleotide
agttatcaggcatttaaaag

SEQ ID NO: 1170 - DNA, 20 bp, Artificial Sequence
  Synthetic polynucleotide
gctaggctgagacaatcatt

SEQ ID NO: 1171 - DNA, 20 bp, Artificial Sequence
  Synthetic polynucleotide
ctctcacatgtcatgtactt

SEQ ID NO: 1172 - DNA, 20 bp, Artificial Sequence
  Synthetic polynucleotide
cagaagcatatttaattaca

SEQ ID NO: 1173 - DNA, 20 bp, Artificial Sequence
  Synthetic polynucleotide
caagttcttacaaaactgaa

SEQ ID NO: 1174 - DNA, 20 bp, Artificial Sequence
  Synthetic polynucleotide
atggatcctaataaattagc

SEQ ID NO: 1175 - DNA, 20 bp, Artificial Sequence
  Synthetic polynucleotide
acgattcgattaaaatggta

SEQ ID NO: 1176 - DNA, 20 bp, Artificial Sequence
  Synthetic polynucleotide
atttagccagtactgacagg

SEQ ID NO: 1177 - DNA, 20 bp, Artificial Sequence
  Synthetic polynucleotide
aaagacctgatatgaaccaa

SEQ ID NO: 1178 - DNA, 20 bp, Artificial Sequence
  Synthetic polynucleotide
ctgaatcgaaattcagtgga

SEQ ID NO: 1179 - DNA, 20 bp, Artificial Sequence
  Synthetic polynucleotide
tccgtccaaacatttatttc

SEQ ID NO: 1180 - DNA, 20 bp, Artificial Sequence
  Synthetic polynucleotide
cacacacgggtatcttaaat

SEQ ID NO: 1181 - DNA, 20 bp, Artificial Sequence
  Synthetic polynucleotide
agacaacttcctgtttaatt

SEQ ID NO: 1182 - DNA, 20 bp, Artificial Sequence
  Synthetic polynucleotide
ctaaagctatgttagtaatt

SEQ ID NO: 1183 - DNA, 20 bp, Artificial Sequence
  Synthetic polynucleotide
gagcatcagtccccgaatta

SEQ ID NO: 1184 - DNA, 20 bp, Artificial Sequence
  Synthetic polynucleotide
gcctagcctctagcgaatta

SEQ ID NO: 1185 - DNA, 20 bp, Artificial Sequence
  Synthetic polynucleotide
atacatctcgttagcagttt

SEQ ID NO: 1186 - DNA, 20 bp, Artificial Sequence
  Synthetic polynucleotide
tctacgctataagacataac

SEQ ID NO: 1187 - DNA, 20 bp, Artificial Sequence
  Synthetic polynucleotide
ttagctcctttctttaggtg

SEQ ID NO: 1188 - DNA, 20 bp, Artificial Sequence
  Synthetic polynucleotide
gtcagacgaaaatcaaagag

SEQ ID NO: 1189 - DNA, 20 bp, Artificial Sequence
  Synthetic polynucleotide
aggtgaccagcacataaggg

SEQ ID NO: 1190 - DNA, 20 bp, Artificial Sequence
  Synthetic polynucleotide
gtacagcttatatttagagg

SEQ ID NO: 1191 - DNA, 20 bp, Artificial Sequence
  Synthetic polynucleotide
aatgtgcacagtaatcctgg

SEQ ID NO: 1192 - DNA, 20 bp, Artificial Sequence
  Synthetic polynucleotide
agcccccagatatcaatcgg

SEQ ID NO: 1193 - DNA, 20 bp, Artificial Sequence
  Synthetic polynucleotide
cgtaaacagaatttcctagt

SEQ ID NO: 1194 - DNA, 20 bp, Artificial Sequence
  Synthetic polynucleotide
gaatgcctcctgacatttct

SEQ ID NO: 1195 - DNA, 20 bp, Artificial Sequence
  Synthetic polynucleotide
cgttgtcggatatcttaatt

SEQ ID NO: 1196 - DNA, 20 bp, Artificial Sequence
  Synthetic polynucleotide
gctggcccttgtacttaatt

SEQ ID NO: 1197 - DNA, 20 bp, Artificial Sequence
  Synthetic polynucleotide
caaggacatactgctaatta

SEQ ID NO: 1198 - DNA, 20 bp, Artificial Sequence
  Synthetic polynucleotide
caatagccaccttgacttta

SEQ ID NO: 1199 - DNA, 20 bp, Artificial Sequence
  Synthetic polynucleotide
gggatgcagtgaacaaatta

SEQ ID NO: 1200 - DNA, 20 bp, Artificial Sequence
  Synthetic polynucleotide
ctttcacaagtaagtattcg

SEQ ID NO: 1201 - DNA, 20 bp, Artificial Sequence
  Synthetic polynucleotide
acgtatcagttcttgtggca

SEQ ID NO: 1202 - DNA, 20 bp, Artificial Sequence
  Synthetic polynucleotide
ctttggctccacgaatactg

SEQ ID NO: 1203 - DNA, 20 bp, Artificial Sequence
  Synthetic polynucleotide
tctttgcaagagaacttggt

SEQ ID NO: 1204 - DNA, 20 bp, Artificial Sequence
  Synthetic polynucleotide
tataatcagcccacgacaaa

SEQ ID NO: 1205 - DNA, 20 bp, Artificial Sequence
  Synthetic polynucleotide
cctttacactacataaagcc

SEQ ID NO: 1206 - DNA, 20 bp, Artificial Sequence
  Synthetic polynucleotide
ggaagacttcagtacacgcc

SEQ ID NO: 1207 - DNA, 20 bp, Artificial Sequence
  Synthetic polynucleotide
cgtcctcaaacttagacgtg

SEQ ID NO: 1208 - DNA, 20 bp, Artificial Sequence
  Synthetic polynucleotide
aggtgacgtcatatcgctga

SEQ ID NO: 1209 - DNA, 20 bp, Artificial Sequence
  Synthetic polynucleotide
ttggctcgcgtaacttaaaa

SEQ ID NO: 1210 - DNA, 20 bp, Artificial Sequence
  Synthetic polynucleotide
gaaggaccactagattaaat

SEQ ID NO: 1211 - DNA, 20 bp, Artificial Sequence
  Synthetic polynucleotide
gagcggccgtttccctttca

SEQ ID NO: 1212 - DNA, 20 bp, Artificial Sequence
  Synthetic polynucleotide
tcgtagcagctcctatataa

SEQ ID NO: 1213 - DNA, 20 bp, Artificial Sequence
  Synthetic polynucleotide
ttgagccgttggcttagtaa

SEQ ID NO: 1214 - DNA, 20 bp, Artificial Sequence
  Synthetic polynucleotide
aggggtctcccgttacatct

SEQ ID NO: 1215 - DNA, 20 bp, Artificial Sequence
  Synthetic polynucleotide
tgattccaattcccgtagct

SEQ ID NO: 1216 - DNA, 20 bp, Artificial Sequence
  Synthetic polynucleotide
gcaattcgagcagacgaatt

SEQ ID NO: 1217 - DNA, 20 bp, Artificial Sequence
  Synthetic polynucleotide
gttattctcaaccgcatctg

SEQ ID NO: 1218 - DNA, 20 bp, Artificial Sequence
  Synthetic polynucleotide
gactgccctcgaaccgaggt

SEQ ID NO: 1219 - DNA, 20 bp, Artificial Sequence
  Synthetic polynucleotide
gtccatcccataccgctggg

SEQ ID NO: 1220 - DNA, 20 bp, Artificial Sequence
  Synthetic polynucleotide
tcataacttgactctattgc

SEQ ID NO: 1221 - DNA, 20 bp, Artificial Sequence
  Synthetic polynucleotide
ctgcgcctgttcacaacgag

SEQ ID NO: 1222 - DNA, 20 bp, Artificial Sequence
  Synthetic polynucleotide
ggagatcccgaaacaccggc

SEQ ID NO: 1223 - DNA, 20 bp, Artificial Sequence
  Synthetic polynucleotide
ggagatctccttcccaatgg

SEQ ID NO: 1224 - DNA, 20 bp, Artificial Sequence
  Synthetic polynucleotide
gccctcccgctccgttataa

SEQ ID NO: 1225 - DNA, 20 bp, Artificial Sequence
  Synthetic polynucleotide
tcccagcgcgcactataaac

SEQ ID NO: 1226 - DNA, 20 bp, Artificial Sequence
  Synthetic polynucleotide
tgctcacgcgaagcttaaac

SEQ ID NO: 1227 - DNA, 20 bp, Artificial Sequence
  Synthetic polynucleotide
cgcgtgcgacggccaatatc

SEQ ID NO: 1228 - DNA, 20 bp, Artificial Sequence
  Synthetic polynucleotide
ctgcctctgcgctctctaag

SEQ ID NO: 1229 - DNA, 20 bp, Artificial Sequence
  Synthetic polynucleotide
ctgctccgactcttagttat

SEQ ID NO: 1230 - DNA, 20 bp, Artificial Sequence
  Synthetic polynucleotide
ccggctcgcttccagcagtg

SEQ ID NO: 1231 - DNA, 20 bp, Artificial Sequence
  Synthetic polynucleotide
gggctcccgacgcaccattg

SEQ ID NO: 1232 - DNA, 20 bp, Artificial Sequence
  Synthetic polynucleotide
ccgtcgcgccctatactgaa

SEQ ID NO: 1233 - DNA, 20 bp, Artificial Sequence
  Synthetic polynucleotide
cctggcctagcctaacaggt

SEQ ID NO: 1234 - DNA, 20 bp, Artificial Sequence
  Synthetic polynucleotide
taacgacaccactctgcgta

SEQ ID NO: 1235 - DNA, 20 bp, Artificial Sequence
  Synthetic polynucleotide
ataagacctcctcgtccggt

SEQ ID NO: 1236 - DNA, 20 bp, Artificial Sequence
  Synthetic polynucleotide
tagtgacgcaatcacaagag

SEQ ID NO: 1237 - DNA, 20 bp, Artificial Sequence
  Synthetic polynucleotide
gggcctccacttaacacgga

SEQ ID NO: 1238 - DNA, 20 bp, Artificial Sequence
  Synthetic polynucleotide
gatcagcaactccgctgggt

SEQ ID NO: 1239 - DNA, 20 bp, Artificial Sequence
  Synthetic polynucleotide
atccttcctataggtaattt

SEQ ID NO: 1240 - DNA, 20 bp, Artificial Sequence
  Synthetic polynucleotide
ttctgtctgggtagtattct

SEQ ID NO: 1241 - DNA, 20 bp, Artificial Sequence
  Synthetic polynucleotide
aaagtgcaatggttatttat

SEQ ID NO: 1242 - DNA, 20 bp, Artificial Sequence
  Synthetic polynucleotide
aaagcccattcggatttctt

SEQ ID NO: 1243 - DNA, 20 bp, Artificial Sequence
  Synthetic polynucleotide
tatatgctgggcactctata

SEQ ID NO: 1244 - DNA, 20 bp, Artificial Sequence
  Synthetic polynucleotide
catttacacataatttgatt

SEQ ID NO: 1245 - DNA, 20 bp, Artificial Sequence
  Synthetic polynucleotide
ttattacttgaaaaaggaaa

SEQ ID NO: 1246 - DNA, 20 bp, Artificial Sequence
  Synthetic polynucleotide
aatgtcctttgtgggtttga

SEQ ID NO: 1247 - DNA, 20 bp, Artificial Sequence
  Synthetic polynucleotide
tacggtctaaaggtaataaa

SEQ ID NO: 1248 - DNA, 20 bp, Artificial Sequence
  Synthetic polynucleotide
tagttgcaatgactaaccaa

SEQ ID NO: 1249 - DNA, 20 bp, Artificial Sequence
  Synthetic polynucleotide
ataaagctgtaagagctaag

SEQ ID NO: 1250 - DNA, 20 bp, Artificial Sequence
  Synthetic polynucleotide
attacacatagtggattgat

SEQ ID NO: 1251 - DNA, 20 bp, Artificial Sequence
  Synthetic polynucleotide
tcgaacctaagaaacaaagt

SEQ ID NO: 1252 - DNA, 20 bp, Artificial Sequence
  Synthetic polynucleotide
tacgcgcaaattagaccaga

SEQ ID NO: 1253 - DNA, 20 bp, Artificial Sequence
  Synthetic polynucleotide
aaatgtcgatcatgaagtga

SEQ ID NO: 1254 - DNA, 20 bp, Artificial Sequence
  Synthetic polynucleotide
ccatatcactttcgtagttt

SEQ ID NO: 1255 - DNA, 20 bp, Artificial Sequence
  Synthetic polynucleotide
cttgttctgttggtctttct

SEQ ID NO: 1256 - DNA, 20 bp, Artificial Sequence
  Synthetic polynucleotide
taatagctgcgtggtaaatg

SEQ ID NO: 1257 - DNA, 20 bp, Artificial Sequence
  Synthetic polynucleotide
tcgaagcgtttgccggaatc

SEQ ID NO: 1258 - DNA, 20 bp, Artificial Sequence
  Synthetic polynucleotide
atcaaacagtgtttggattt

SEQ ID NO: 1259 - DNA, 20 bp, Artificial Sequence
  Synthetic polynucleotide
aaggagcgattgcggtattt

SEQ ID NO: 1260 - DNA, 20 bp, Artificial Sequence
  Synthetic polynucleotide
ggatcacattcagtggattg

SEQ ID NO: 1261 - DNA, 20 bp, Artificial Sequence
  Synthetic polynucleotide
atttagctcgtgtatagata

SEQ ID NO: 1262 - DNA, 20 bp, Artificial Sequence
  Synthetic polynucleotide
attacgcgatttatgggtgt

SEQ ID NO: 1263 - DNA, 20 bp, Artificial Sequence
  Synthetic polynucleotide
catacacccgatccaggaac

SEQ ID NO: 1264 - DNA, 20 bp, Artificial Sequence
  Synthetic polynucleotide
tgttatcgatgcgatcacga

SEQ ID NO: 1265 - DNA, 20 bp, Artificial Sequence
  Synthetic polynucleotide
aatagactatcaggcatcat

SEQ ID NO: 1266 - DNA, 20 bp, Artificial Sequence
  Synthetic polynucleotide
taatgacttgaagacaagac

SEQ ID NO: 1267 - DNA, 20 bp, Artificial Sequence
  Synthetic polynucleotide
aaattccattaggtcaccac

SEQ ID NO: 1268 - DNA, 20 bp, Artificial Sequence
  Synthetic polynucleotide
taagcgctcaagatgaatga

SEQ ID NO: 1269 - DNA, 20 bp, Artificial Sequence
  Synthetic polynucleotide
tctttgcactttggttagtt

SEQ ID NO: 1270 - DNA, 20 bp, Artificial Sequence
  Synthetic polynucleotide
gtggtacgtatgggataaat

SEQ ID NO: 1271 - DNA, 20 bp, Artificial Sequence
  Synthetic polynucleotide
atctctccttgtgggcttca

SEQ ID NO: 1272 - DNA, 20 bp, Artificial Sequence
  Synthetic polynucleotide
atctcactgctatttagtta

SEQ ID NO: 1273 - DNA, 20 bp, Artificial Sequence
  Synthetic polynucleotide
agtggtccattcgggtattc

SEQ ID NO: 1274 - DNA, 20 bp, Artificial Sequence
  Synthetic polynucleotide
tacaggcatcctccttgtct

SEQ ID NO: 1275 - DNA, 20 bp, Artificial Sequence
  Synthetic polynucleotide
attatgcgtagcacgagata

SEQ ID NO: 1276 - DNA, 20 bp, Artificial Sequence
  Synthetic polynucleotide
tagagacccatgtcaggcca

SEQ ID NO: 1277 - DNA, 20 bp, Artificial Sequence
  Synthetic polynucleotide
atggggctaggtaagcagct

SEQ ID NO: 1278 - DNA, 20 bp, Artificial Sequence
  Synthetic polynucleotide
tgaacgcgttccggcagacc

SEQ ID NO: 1279 - DNA, 20 bp, Artificial Sequence
  Synthetic polynucleotide
cttcatccaagggtagagac

SEQ ID NO: 1280 - DNA, 20 bp, Artificial Sequence
  Synthetic polynucleotide
gaaaagccttaaacggccaa

SEQ ID NO: 1281 - DNA, 20 bp, Artificial Sequence
  Synthetic polynucleotide
gaagtaccgatattgctcgc

SEQ ID NO: 1282 - DNA, 20 bp, Artificial Sequence
  Synthetic polynucleotide
atagtccgaaacctgacacc

SEQ ID NO: 1283 - DNA, 20 bp, Artificial Sequence
  Synthetic polynucleotide
aaagcgcaggaccttaccgc

SEQ ID NO: 1284 - DNA, 20 bp, Artificial Sequence
  Synthetic polynucleotide
acaattccgggcgtaatttc

SEQ ID NO: 1285 - DNA, 20 bp, Artificial Sequence
  Synthetic polynucleotide
ataagtccgttagggtttaa

SEQ ID NO: 1286 - DNA, 20 bp, Artificial Sequence
  Synthetic polynucleotide
gtcactctatccgggtttaa

SEQ ID NO: 1287 - DNA, 20 bp, Artificial Sequence
  Synthetic polynucleotide
tgcatccttgacgcatacct

SEQ ID NO: 1288 - DNA, 20 bp, Artificial Sequence
  Synthetic polynucleotide
aaatttcagccggaacaaac

SEQ ID NO: 1289 - DNA, 20 bp, Artificial Sequence
  Synthetic polynucleotide
caaaagcgtgcttctgatct

SEQ ID NO: 1290 - DNA, 20 bp, Artificial Sequence
  Synthetic polynucleotide
acagggcatcataggtgcct

SEQ ID NO: 1291 - DNA, 20 bp, Artificial Sequence
  Synthetic polynucleotide
ttatgccgactttgcagttg

SEQ ID NO: 1292 - DNA, 20 bp, Artificial Sequence
  Synthetic polynucleotide
ctgtcccaactttcgtggcg

SEQ ID NO: 1293 - DNA, 20 bp, Artificial Sequence
  Synthetic polynucleotide
agttgtcgtagtgggcgcga

SEQ ID NO: 1294 - DNA, 20 bp, Artificial Sequence
  Synthetic polynucleotide
tataagcgcgtaggcaatgg

SEQ ID NO: 1295 - DNA, 20 bp, Artificial Sequence
  Synthetic polynucleotide
ggagttcctcttaccggatc

SEQ ID NO: 1296 - DNA, 20 bp, Artificial Sequence
  Synthetic polynucleotide
cacctaccagacctcaactc

SEQ ID NO: 1297 - DNA, 20 bp, Artificial Sequence
  Synthetic polynucleotide
gcggtcccgtaaaacagaac

SEQ ID NO: 1298 - DNA, 20 bp, Artificial Sequence
  Synthetic polynucleotide
agtaaacatctatgcggagg

SEQ ID NO: 1299 - DNA, 20 bp, Artificial Sequence
  Synthetic polynucleotide
caggacctggcgcttattct

SEQ ID NO: 1300 - DNA, 20 bp, Artificial Sequence
  Synthetic polynucleotide
tcgacactcatggcctttcc

SEQ ID NO: 1301 - DNA, 20 bp, Artificial Sequence
  Synthetic polynucleotide
aatccccgcactggacttct

SEQ ID NO: 1302 - DNA, 20 bp, Artificial Sequence
  Synthetic polynucleotide
cgcgtccaggaggcagttta

SEQ ID NO: 1303 - DNA, 20 bp, Artificial Sequence
  Synthetic polynucleotide
ggcgccccgtcgctacttac

SEQ ID NO: 1304 - DNA, 20 bp, Artificial Sequence
  Synthetic polynucleotide
ccgcgacgcggtccggcgtt

SEQ ID NO: 1305 - DNA, 20 bp, Artificial Sequence
  Synthetic polynucleotide
ctactccatcactgggactt

SEQ ID NO: 1306 - DNA, 20 bp, Artificial Sequence
  Synthetic polynucleotide
cggctccggcgacacgagac

SEQ ID NO: 1307 - DNA, 20 bp, Artificial Sequence
  Synthetic polynucleotide
ttcgcccgttaacggggcaa

SEQ ID NO: 1308 - DNA, 20 bp, Artificial Sequence
  Synthetic polynucleotide
ttcggccccggtacaacgta

SEQ ID NO: 1309 - DNA, 20 bp, Artificial Sequence
  Synthetic polynucleotide
gtccggcggaagcggacgac

SEQ ID NO: 1310 - DNA, 20 bp, Artificial Sequence
  Synthetic polynucleotide
ggccgtctcccttgacgaga

SEQ ID NO: 1311 - DNA, 20 bp, Artificial Sequence
  Synthetic polynucleotide
ttcatcccaactgtccgggc

SEQ ID NO: 1312 - DNA, 20 bp, Artificial Sequence
  Synthetic polynucleotide
gatctgccaggctctccagg

SEQ ID NO: 1313 - DNA, 20 bp, Artificial Sequence
  Synthetic polynucleotide
agacacctcttctgcagcgc

SEQ ID NO: 1314 - DNA, 20 bp, Artificial Sequence
  Synthetic polynucleotide
aatctacaaaaataataaat

SEQ ID NO: 1315 - DNA, 20 bp, Artificial Sequence
  Synthetic polynucleotide
cagggactatttgctattta

SEQ ID NO: 1316 - DNA, 20 bp, Artificial Sequence
  Synthetic polynucleotide
ttacctcgtttctataattt

SEQ ID NO: 1317 - DNA, 20 bp, Artificial Sequence
  Synthetic polynucleotide
ccggtgcaaatagggaataa

SEQ ID NO: 1318 - DNA, 20 bp, Artificial Sequence
  Synthetic polynucleotide
gtaatcctaatggggatatt

SEQ ID NO: 1319 - DNA, 20 bp, Artificial Sequence
  Synthetic polynucleotide
gaaatgccttaaattgaatg

SEQ ID NO: 1320 - DNA, 20 bp, Artificial Sequence
  Synthetic polynucleotide
aaattgctaatttcaggaca

SEQ ID NO: 1321 - DNA, 20 bp, Artificial Sequence
  Synthetic polynucleotide
gaaagtcagagtagacatag

SEQ ID NO: 1322 - DNA, 20 bp, Artificial Sequence
  Synthetic polynucleotide
gttcacctggtaaagggtta

SEQ ID NO: 1323 - DNA, 20 bp, Artificial Sequence
  Synthetic polynucleotide
tacaagctagtataaaggaa

SEQ ID NO: 1324 - DNA, 20 bp, Artificial Sequence
  Synthetic polynucleotide
gtgctactgatcgggtagga

SEQ ID NO: 1325 - DNA, 20 bp, Artificial Sequence
  Synthetic polynucleotide
ttcacacacgtttataacca

SEQ ID NO: 1326 - DNA, 20 bp, Artificial Sequence
  Synthetic polynucleotide
ataaatcctatgaacaacaa

SEQ ID NO: 1327 - DNA, 20 bp, Artificial Sequence
  Synthetic polynucleotide
tttaaccgttagaacgacga

SEQ ID NO: 1328 - DNA, 20 bp, Artificial Sequence
  Synthetic polynucleotide
tttggccatgatagatctga

SEQ ID NO: 1329 - DNA, 20 bp, Artificial Sequence
  Synthetic polynucleotide
agttggctggtttgtcttct

SEQ ID NO: 1330 - DNA, 20 bp, Artificial Sequence
  Synthetic polynucleotide
caattgctattgcgtcttct

SEQ ID NO: 1331 - DNA, 20 bp, Artificial Sequence
  Synthetic polynucleotide
gtaattcgggtttggtatct

SEQ ID NO: 1332 - DNA, 20 bp, Artificial Sequence
  Synthetic polynucleotide
ttaaaccagttggtaatttg

SEQ ID NO: 1333 - DNA, 20 bp, Artificial Sequence
  Synthetic polynucleotide
agtggtctctcctatgattg

SEQ ID NO: 1334 - DNA, 20 bp, Artificial Sequence
  Synthetic polynucleotide
cgttctctaatgtctgattc

SEQ ID NO: 1335 - DNA, 20 bp, Artificial Sequence
  Synthetic polynucleotide
ataatgcacttgggaggaat

SEQ ID NO: 1336 - DNA, 20 bp, Artificial Sequence
  Synthetic polynucleotide
aacacgcaggggactcataa

SEQ ID NO: 1337 - DNA, 20 bp, Artificial Sequence
  Synthetic polynucleotide
aaagttctctggctagactg

SEQ ID NO: 1338 - DNA, 20 bp, Artificial Sequence
  Synthetic polynucleotide
caggttctagtttatggtgg

SEQ ID NO: 1339 - DNA, 20 bp, Artificial Sequence
  Synthetic polynucleotide
catacacgctctgggatggt

SEQ ID NO: 1340 - DNA, 20 bp, Artificial Sequence
  Synthetic polynucleotide
aaagtacaatgtaacgcaag

SEQ ID NO: 1341 - DNA, 20 bp, Artificial Sequence
  Synthetic polynucleotide
taggagctcaatagaaccat

SEQ ID NO: 1342 - DNA, 20 bp, Artificial Sequence
  Synthetic polynucleotide
accaatcagaccaacacgac

SEQ ID NO: 1343 - DNA, 20 bp, Artificial Sequence
  Synthetic polynucleotide
gaaacacaggagagacagac

SEQ ID NO: 1344 - DNA, 20 bp, Artificial Sequence
  Synthetic polynucleotide
gcaattccgttgcatggttt

SEQ ID NO: 1345 - DNA, 20 bp, Artificial Sequence
  Synthetic polynucleotide
aatgggcctttacattcttt

SEQ ID NO: 1346 - DNA, 20 bp, Artificial Sequence
  Synthetic polynucleotide
ggaatacaacgggaaattat

SEQ ID NO: 1347 - DNA, 20 bp, Artificial Sequence
  Synthetic polynucleotide
aaataactgcgttgggactg

SEQ ID NO: 1348 - DNA, 20 bp, Artificial Sequence
  Synthetic polynucleotide
ggctgtcatttggcagctat

SEQ ID NO: 1349 - DNA, 20 bp, Artificial Sequence
  Synthetic polynucleotide
tccgagcggttgtgttggtt

SEQ ID NO: 1350 - DNA, 20 bp, Artificial Sequence
  Synthetic polynucleotide
tctgggcccagatggttgtt

SEQ ID NO: 1351 - DNA, 20 bp, Artificial Sequence
  Synthetic polynucleotide
ttcttgcccgtaaaagggct

SEQ ID NO: 1352 - DNA, 20 bp, Artificial Sequence
  Synthetic polynucleotide
taagtactggtttgggactc

SEQ ID NO: 1353 - DNA, 20 bp, Artificial Sequence
  Synthetic polynucleotide
aagacccgatatgtagagaa

SEQ ID NO: 1354 - DNA, 20 bp, Artificial Sequence
  Synthetic polynucleotide
gcgggacaaccttaatgaac

SEQ ID NO: 1355 - DNA, 20 bp, Artificial Sequence
  Synthetic polynucleotide
atatcgcaaagcttagggtg

SEQ ID NO: 1356 - DNA, 20 bp, Artificial Sequence
  Synthetic polynucleotide
aatactcgctactcgtacac

SEQ ID NO: 1357 - DNA, 20 bp, Artificial Sequence
  Synthetic polynucleotide
gagtgccctaagatgtgatg

SEQ ID NO: 1358 - DNA, 20 bp, Artificial Sequence
  Synthetic polynucleotide
ttggctctaaaaggcaccaa

SEQ ID NO: 1359 - DNA, 20 bp, Artificial Sequence
  Synthetic polynucleotide
tgctctcgtccccgtaaaac

SEQ ID NO: 1360 - DNA, 20 bp, Artificial Sequence
  Synthetic polynucleotide
gtcgctcacccggcttaaat

SEQ ID NO: 1361 - DNA, 20 bp, Artificial Sequence
  Synthetic polynucleotide
gtccctcgcatgtcctttct

SEQ ID NO: 1362 - DNA, 20 bp, Artificial Sequence
  Synthetic polynucleotide
aatccccggtggcaatcttg

SEQ ID NO: 1363 - DNA, 20 bp, Artificial Sequence
  Synthetic polynucleotide
ccgctgcgccaagttgaatg

SEQ ID NO: 1364 - DNA, 20 bp, Artificial Sequence
  Synthetic polynucleotide
tgtcttcgtactggcttccg

SEQ ID NO: 1365 - DNA, 20 bp, Artificial Sequence
  Synthetic polynucleotide
ttgtatctacgggtagcctt

SEQ ID NO: 1366 - DNA, 20 bp, Artificial Sequence
  Synthetic polynucleotide
gacgctcaaatgggtactcg

SEQ ID NO: 1367 - DNA, 20 bp, Artificial Sequence
  Synthetic polynucleotide
ctatcacggcggaaacatta

SEQ ID NO: 1368 - DNA, 20 bp, Artificial Sequence
  Synthetic polynucleotide
agaacacactagtggctgtt

SEQ ID NO: 1369 - DNA, 20 bp, Artificial Sequence
  Synthetic polynucleotide
ctggagctaatatctgaggc

SEQ ID NO: 1370 - DNA, 20 bp, Artificial Sequence
  Synthetic polynucleotide
acggagccctcgtaggacga

SEQ ID NO: 1371 - DNA, 20 bp, Artificial Sequence
  Synthetic polynucleotide
agtctgcataggataggtgc

SEQ ID NO: 1372 - DNA, 20 bp, Artificial Sequence
  Synthetic polynucleotide
gcaccccactgattgaccac

SEQ ID NO: 1373 - DNA, 20 bp, Artificial Sequence
  Synthetic polynucleotide
ggatcaccgagattcgagga

SEQ ID NO: 1374 - DNA, 20 bp, Artificial Sequence
  Synthetic polynucleotide
gctgagctgggcacacattt

SEQ ID NO: 1375 - DNA, 20 bp, Artificial Sequence
  Synthetic polynucleotide
gcactgcgactgctggaatt

SEQ ID NO: 1376 - DNA, 20 bp, Artificial Sequence
  Synthetic polynucleotide
ccagcactgctagcgtttct

SEQ ID NO: 1377 - DNA, 20 bp, Artificial Sequence
  Synthetic polynucleotide
agctggcacacggcctctat

SEQ ID NO: 1378 - DNA, 20 bp, Artificial Sequence
  Synthetic polynucleotide
cagctgccgtgctcatgcct

SEQ ID NO: 1379 - DNA, 20 bp, Artificial Sequence
  Synthetic polynucleotide
cttggccagccacgcgaact

SEQ ID NO: 1380 - DNA, 20 bp, Artificial Sequence
  Synthetic polynucleotide
tattaccgcgcgcggacaca

SEQ ID NO: 1381 - DNA, 20 bp, Artificial Sequence
  Synthetic polynucleotide
cacgaccccacacgacgtcg

SEQ ID NO: 1382 - DNA, 20 bp, Artificial Sequence
  Synthetic polynucleotide
gacctcccttgcggtggagt

SEQ ID NO: 1383 - DNA, 20 bp, Artificial Sequence
  Synthetic polynucleotide
cccgttcggagtgccctagt

SEQ ID NO: 1384 - DNA, 20 bp, Artificial Sequence
  Synthetic polynucleotide
cccatacctgagcgacggag

SEQ ID NO: 1385 - DNA, 20 bp, Artificial Sequence
  Synthetic polynucleotide
tcgagccacaagcgtgactg

SEQ ID NO: 1386 - DNA, 20 bp, Artificial Sequence
  Synthetic polynucleotide
ctggtacttagcatgaaagc

SEQ ID NO: 1387 - DNA, 20 bp, Artificial Sequence
  Synthetic polynucleotide
actccgcaagacctatgaga

SEQ ID NO: 1388 - DNA, 20 bp, Artificial Sequence
  Synthetic polynucleotide
cggtcccacgatagccaggt

SEQ ID NO: 1389 - DNA, 20 bp, Artificial Sequence
  Synthetic polynucleotide
aaacgtcttagtagttattt

SEQ ID NO: 1390 - DNA, 20 bp, Artificial Sequence
  Synthetic polynucleotide
tggcttctgagtgtttaatt

SEQ ID NO: 1391 - DNA, 20 bp, Artificial Sequence
  Synthetic polynucleotide
gtataaccaattatttaatt

SEQ ID NO: 1392 - DNA, 20 bp, Artificial Sequence
  Synthetic polynucleotide
taggatcttatacgattatc

SEQ ID NO: 1393 - DNA, 20 bp, Artificial Sequence
  Synthetic polynucleotide
cgagttcaaggagttaatag

SEQ ID NO: 1394 - DNA, 20 bp, Artificial Sequence
  Synthetic polynucleotide
agattgccaaaagaatataa

SEQ ID NO: 1395 - DNA, 20 bp, Artificial Sequence
  Synthetic polynucleotide
ttcagtcggtttgatcgtat

SEQ ID NO: 1396 - DNA, 20 bp, Artificial Sequence
  Synthetic polynucleotide
atagttcaaatgtaatgttg

SEQ ID NO: 1397 - DNA, 20 bp, Artificial Sequence
  Synthetic polynucleotide
taagtgcgccactaaaataa

SEQ ID NO: 1398 - DNA, 20 bp, Artificial Sequence
  Synthetic polynucleotide
agatgaccctatataaacaa

SEQ ID NO: 1399 - DNA, 20 bp, Artificial Sequence
  Synthetic polynucleotide
aagaaactacctcaagtaaa

SEQ ID NO: 1400 - DNA, 20 bp, Artificial Sequence
  Synthetic polynucleotide
aggtcacgggagttgtgaga

SEQ ID NO: 1401 - DNA, 20 bp, Artificial Sequence
  Synthetic polynucleotide
atgaaacggaactgatgtgt

SEQ ID NO: 1402 - DNA, 20 bp, Artificial Sequence
  Synthetic polynucleotide
atgagccatgacaaaaccaa

SEQ ID NO: 1403 - DNA, 20 bp, Artificial Sequence
  Synthetic polynucleotide
cagtaccaagttaaaaacaa

SEQ ID NO: 1404 - DNA, 20 bp, Artificial Sequence
  Synthetic polynucleotide
tcatggccgttataattatt

SEQ ID NO: 1405 - DNA, 20 bp, Artificial Sequence
  Synthetic polynucleotide
tcattgccatcaaaataaat

SEQ ID NO: 1406 - DNA, 20 bp, Artificial Sequence
  Synthetic polynucleotide
tgtcatcgttgtcgttattt

SEQ ID NO: 1407 - DNA, 20 bp, Artificial Sequence
  Synthetic polynucleotide
taaggcctgttgaagattta

SEQ ID NO: 1408 - DNA, 20 bp, Artificial Sequence
  Synthetic polynucleotide
acaaaccgagggctataatc

SEQ ID NO: 1409 - DNA, 20 bp, Artificial Sequence
  Synthetic polynucleotide
gatgatctcggggagatatt

SEQ ID NO: 1410 - DNA, 20 bp, Artificial Sequence
  Synthetic polynucleotide
ctacgtcctaaaatcaaaaa

SEQ ID NO: 1411 - DNA, 20 bp, Artificial Sequence
  Synthetic polynucleotide
aactaactggagggagtact

SEQ ID NO: 1412 - DNA, 20 bp, Artificial Sequence
  Synthetic polynucleotide
aatttcctgcacccaaaaaa

SEQ ID NO: 1413 - DNA, 20 bp, Artificial Sequence
  Synthetic polynucleotide
gtttccctgaactcgtatga

SEQ ID NO: 1414 - DNA, 20 bp, Artificial Sequence
  Synthetic polynucleotide
ggtttacgatagcccgtact

SEQ ID NO: 1415 - DNA, 20 bp, Artificial Sequence
  Synthetic polynucleotide
ttgctgctagtgatcaggct

SEQ ID NO: 1416 - DNA, 20 bp, Artificial Sequence
  Synthetic polynucleotide
agatcacaaagaaagtcagg

SEQ ID NO: 1417 - DNA, 20 bp, Artificial Sequence
  Synthetic polynucleotide
tacgcactagtacaattggt

SEQ ID NO: 1418 - DNA, 20 bp, Artificial Sequence
  Synthetic polynucleotide
agtactcagagctacggaac

SEQ ID NO: 1419 - DNA, 20 bp, Artificial Sequence
  Synthetic polynucleotide
accaaacctcttgctattta

SEQ ID NO: 1420 - DNA, 20 bp, Artificial Sequence
  Synthetic polynucleotide
atcctacgcagggagtttct

SEQ ID NO: 1421 - DNA, 20 bp, Artificial Sequence
  Synthetic polynucleotide
cacttcctcttagaccttct

SEQ ID NO: 1422 - DNA, 20 bp, Artificial Sequence
  Synthetic polynucleotide
aacgctctaggaaaataaaa

SEQ ID NO: 1423 - DNA, 20 bp, Artificial Sequence
  Synthetic polynucleotide
attccgcacactgcaattcc

SEQ ID NO: 1424 - DNA, 20 bp, Artificial Sequence
  Synthetic polynucleotide
tacgctctggtttatgcttg

SEQ ID NO: 1425 - DNA, 20 bp, Artificial Sequence
  Synthetic polynucleotide
ttggttctattgtctgctgt

SEQ ID NO: 1426 - DNA, 20 bp, Artificial Sequence
  Synthetic polynucleotide
aaaagacttgcgcgctgctc

SEQ ID NO: 1427 - DNA, 20 bp, Artificial Sequence
  Synthetic polynucleotide
tctacactgatgctggtcgt

SEQ ID NO: 1428 - DNA, 20 bp, Artificial Sequence
  Synthetic polynucleotide
ggagaactcaagcatgacat

SEQ ID NO: 1429 - DNA, 20 bp, Artificial Sequence
  Synthetic polynucleotide
caagtgcgttaaggatcggt

SEQ ID NO: 1430 - DNA, 20 bp, Artificial Sequence
  Synthetic polynucleotide
attacacctcctacggtaac

SEQ ID NO: 1431 - DNA, 20 bp, Artificial Sequence
  Synthetic polynucleotide
gagtgccagagacacggtgg

SEQ ID NO: 1432 - DNA, 20 bp, Artificial Sequence
  Synthetic polynucleotide
gatgaccgagtctacggtgc

SEQ ID NO: 1433 - DNA, 20 bp, Artificial Sequence
  Synthetic polynucleotide
ctgaagcactaaggttcagc

SEQ ID NO: 1434 - DNA, 20 bp, Artificial Sequence
  Synthetic polynucleotide
aaatagcgtcccttatttcc

SEQ ID NO: 1435 - DNA, 20 bp, Artificial Sequence
  Synthetic polynucleotide
agtgggcggggagtgcctct

SEQ ID NO: 1436 - DNA, 20 bp, Artificial Sequence
  Synthetic polynucleotide
ttcagtcgtatgtggtaatt

SEQ ID NO: 1437 - DNA, 20 bp, Artificial Sequence
  Synthetic polynucleotide
ccaatgcgtttggccgggtg

SEQ ID NO: 1438 - DNA, 20 bp, Artificial Sequence
  Synthetic polynucleotide
gttctgcatgtatggccttt

SEQ ID NO: 1439 - DNA, 20 bp, Artificial Sequence
  Synthetic polynucleotide
ctcgaccgcttcaggtgttt

SEQ ID NO: 1440 - DNA, 20 bp, Artificial Sequence
  Synthetic polynucleotide
catgttcaccgttcgggcca

SEQ ID NO: 1441 - DNA, 20 bp, Artificial Sequence
  Synthetic polynucleotide
tcacggccggccaactacca

SEQ ID NO: 1442 - DNA, 20 bp, Artificial Sequence
  Synthetic polynucleotide
agggcacctgggccattgtc

SEQ ID NO: 1443 - DNA, 20 bp, Artificial Sequence
  Synthetic polynucleotide
cagacccatccggagcagtg

SEQ ID NO: 1444 - DNA, 20 bp, Artificial Sequence
  Synthetic polynucleotide
accacccgaccgcacttcga

SEQ ID NO: 1445 - DNA, 20 bp, Artificial Sequence
  Synthetic polynucleotide
tgagggcatgatatggacac

SEQ ID NO: 1446 - DNA, 20 bp, Artificial Sequence
  Synthetic polynucleotide
agataaccgtggataaaggc

SEQ ID NO: 1447 - DNA, 20 bp, Artificial Sequence
  Synthetic polynucleotide
aaattgctgatgaccctggc

SEQ ID NO: 1448 - DNA, 20 bp, Artificial Sequence
  Synthetic polynucleotide
caaacacggttacggacgag

SEQ ID NO: 1449 - DNA, 20 bp, Artificial Sequence
  Synthetic polynucleotide
gcgcgacagcctatgcttct

SEQ ID NO: 1450 - DNA, 20 bp, Artificial Sequence
  Synthetic polynucleotide
ggagtccgggacccctttca

SEQ ID NO: 1451 - DNA, 20 bp, Artificial Sequence
  Synthetic polynucleotide
taaacgcgctccagtatttc

SEQ ID NO: 1452 - DNA, 20 bp, Artificial Sequence
  Synthetic polynucleotide
ccacttcccattggtttgtc

SEQ ID NO: 1453 - DNA, 20 bp, Artificial Sequence
  Synthetic polynucleotide
cacgtccatgcttggcacct

SEQ ID NO: 1454 - DNA, 20 bp, Artificial Sequence
  Synthetic polynucleotide
cctagtcagcacggttaacg

SEQ ID NO: 1455 - DNA, 20 bp, Artificial Sequence
  Synthetic polynucleotide
agctcacacgctgctaccgg

SEQ ID NO: 1456 - DNA, 20 bp, Artificial Sequence
  Synthetic polynucleotide
ccacagcgttggtgtccccg

SEQ ID NO: 1457 - DNA, 20 bp, Artificial Sequence
  Synthetic polynucleotide
gactacctacggagggataa

SEQ ID NO: 1458 - DNA, 20 bp, Artificial Sequence
  Synthetic polynucleotide
cgccgcccccggtacccgag

SEQ ID NO: 1459 - DNA, 20 bp, Artificial Sequence
  Synthetic polynucleotide
tgtgcgcgttactggaaggg

SEQ ID NO: 1460 - DNA, 20 bp, Artificial Sequence
  Synthetic polynucleotide
gccgcgcgattcttaccagc

SEQ ID NO: 1461 - DNA, 20 bp, Artificial Sequence
  Synthetic polynucleotide
ctattccggaggaacagggt

SEQ ID NO: 1462 - DNA, 20 bp, Artificial Sequence
  Synthetic polynucleotide
caagcgctgtgtatgaacgc

SEQ ID NO: 1463 - DNA, 20 bp, Artificial Sequence
  Synthetic polynucleotide
taaaccctaggcctcgacac

SEQ ID NO: 1464 - DNA, 20 bp, Artificial Sequence
  Synthetic polynucleotide
tactagcttattcttaattt

SEQ ID NO: 1465 - DNA, 20 bp, Artificial Sequence
  Synthetic polynucleotide
tctgacctattaattatttc

SEQ ID NO: 1466 - DNA, 20 bp, Artificial Sequence
  Synthetic polynucleotide
gattctccacaaaagtttct

SEQ ID NO: 1467 - DNA, 20 bp, Artificial Sequence
  Synthetic polynucleotide
atcattcctttgtcatgatt

SEQ ID NO: 1468 - DNA, 20 bp, Artificial Sequence
  Synthetic polynucleotide
cttaatccactatattaaac

SEQ ID NO: 1469 - DNA, 20 bp, Artificial Sequence
  Synthetic polynucleotide
aatttgcattggtttcaatt

SEQ ID NO: 1470 - DNA, 20 bp, Artificial Sequence
  Synthetic polynucleotide
atattacgaaagtgaagaat

SEQ ID NO: 1471 - DNA, 20 bp, Artificial Sequence
  Synthetic polynucleotide
aaaaatcacaagtaaaatac

SEQ ID NO: 1472 - DNA, 20 bp, Artificial Sequence
  Synthetic polynucleotide
caacttcttctttctctgtt

SEQ ID NO: 1473 - DNA, 20 bp, Artificial Sequence
  Synthetic polynucleotide
taaagacggaacatatgaaa

SEQ ID NO: 1474 - DNA, 20 bp, Artificial Sequence
  Synthetic polynucleotide
taagagctataaaaaatggt

SEQ ID NO: 1475 - DNA, 20 bp, Artificial Sequence
  Synthetic polynucleotide
gagtatcagatattaatcat

SEQ ID NO: 1476 - DNA, 20 bp, Artificial Sequence
  Synthetic polynucleotide
cagcggcaagataacaacat

SEQ ID NO: 1477 - DNA, 20 bp, Artificial Sequence
  Synthetic polynucleotide
caatgccaatagagatgtga

SEQ ID NO: 1478 - DNA, 20 bp, Artificial Sequence
  Synthetic polynucleotide
gaatcacagaaggacgaagc

SEQ ID NO: 1479 - DNA, 20 bp, Artificial Sequence
  Synthetic polynucleotide
tgttccctcttactattcct

SEQ ID NO: 1480 - DNA, 20 bp, Artificial Sequence
  Synthetic polynucleotide
ttaattctctgacccttatt

SEQ ID NO: 1481 - DNA, 20 bp, Artificial Sequence
  Synthetic polynucleotide
gagtcgctatttggataatt

SEQ ID NO: 1482 - DNA, 20 bp, Artificial Sequence
  Synthetic polynucleotide
tctaagctcaaacaaaattc

SEQ ID NO: 1483 - DNA, 20 bp, Artificial Sequence
  Synthetic polynucleotide
attcggcatttgtcattgtt

SEQ ID NO: 1484 - DNA, 20 bp, Artificial Sequence
  Synthetic polynucleotide
gccatgcgatcaatttagct

SEQ ID NO: 1485 - DNA, 20 bp, Artificial Sequence
  Synthetic polynucleotide
atgttccgaccagcttcctc

SEQ ID NO: 1486 - DNA, 20 bp, Artificial Sequence
  Synthetic polynucleotide
aggattctccattgatgatt

SEQ ID NO: 1487 - DNA, 20 bp, Artificial Sequence
  Synthetic polynucleotide
tgggtaccaaaagcaagaaa

SEQ ID NO: 1488 - DNA, 20 bp, Artificial Sequence
  Synthetic polynucleotide
aatcaacgatggtatcgaag

SEQ ID NO: 1489 - DNA, 20 bp, Artificial Sequence
  Synthetic polynucleotide
gctgttctcggtataatcgt

SEQ ID NO: 1490 - DNA, 20 bp, Artificial Sequence
  Synthetic polynucleotide
accatactactggtaaccaa

SEQ ID NO: 1491 - DNA, 20 bp, Artificial Sequence
  Synthetic polynucleotide
taggagccatggtagtacgc

SEQ ID NO: 1492 - DNA, 20 bp, Artificial Sequence
  Synthetic polynucleotide
cacgatcccatctacaacgc

SEQ ID NO: 1493 - DNA, 20 bp, Artificial Sequence
  Synthetic polynucleotide
atgtgtcaacggaaacgtga

SEQ ID NO: 1494 - DNA, 20 bp, Artificial Sequence
  Synthetic polynucleotide
ataccgccctgttcctttca

SEQ ID NO: 1495 - DNA, 20 bp, Artificial Sequence
  Synthetic polynucleotide
atgccacgccatatataatt

SEQ ID NO: 1496 - DNA, 20 bp, Artificial Sequence
  Synthetic polynucleotide
atggatctgtgagtgttact

SEQ ID NO: 1497 - DNA, 20 bp, Artificial Sequence
  Synthetic polynucleotide
taggacctctcatgttatcg

SEQ ID NO: 1498 - DNA, 20 bp, Artificial Sequence
  Synthetic polynucleotide
gttaagcttgtggaaataaa

SEQ ID NO: 1499 - DNA, 20 bp, Artificial Sequence
  Synthetic polynucleotide
attaaccaagtggtaaatta

SEQ ID NO: 1500 - DNA, 20 bp, Artificial Sequence
  Synthetic polynucleotide
ggatggctgcaagagtgtca

SEQ ID NO: 1501 - DNA, 20 bp, Artificial Sequence
  Synthetic polynucleotide
cagggcctactcaacgaaat

SEQ ID NO: 1502 - DNA, 20 bp, Artificial Sequence
  Synthetic polynucleotide
acccgtcacgcgggcgatta

SEQ ID NO: 1503 - DNA, 20 bp, Artificial Sequence
  Synthetic polynucleotide
gttgctccagggagcgatat

SEQ ID NO: 1504 - DNA, 20 bp, Artificial Sequence
  Synthetic polynucleotide
gggtacccattaccatgatc

SEQ ID NO: 1505 - DNA, 20 bp, Artificial Sequence
  Synthetic polynucleotide
tagggacgatctgttgtaag

SEQ ID NO: 1506 - DNA, 20 bp, Artificial Sequence
  Synthetic polynucleotide
tataggcaacaaaccgacac

SEQ ID NO: 1507 - DNA, 20 bp, Artificial Sequence
  Synthetic polynucleotide
gagagacccgaataacccgt

SEQ ID NO: 1508 - DNA, 20 bp, Artificial Sequence
  Synthetic polynucleotide
ccgggtcagttgaaaaacgg

SEQ ID NO: 1509 - DNA, 20 bp, Artificial Sequence
  Synthetic polynucleotide
ggtttgcgctcaaatagttt

SEQ ID NO: 1510 - DNA, 20 bp, Artificial Sequence
  Synthetic polynucleotide
ccctaccccttggctttctc

SEQ ID NO: 1511 - DNA, 20 bp, Artificial Sequence
  Synthetic polynucleotide
tcgtacccgtaacgccttct

SEQ ID NO: 1512 - DNA, 20 bp, Artificial Sequence
  Synthetic polynucleotide
tttgaccgaaccagaattaa

SEQ ID NO: 1513 - DNA, 20 bp, Artificial Sequence
  Synthetic polynucleotide
agccctcctgattgagatct

SEQ ID NO: 1514 - DNA, 20 bp, Artificial Sequence
  Synthetic polynucleotide
aaacggccccgaggcattat

SEQ ID NO: 1515 - DNA, 20 bp, Artificial Sequence
  Synthetic polynucleotide
agaatgccgcctccatctta

SEQ ID NO: 1516 - DNA, 20 bp, Artificial Sequence
  Synthetic polynucleotide
gttcgtcactacagctccct

SEQ ID NO: 1517 - DNA, 20 bp, Artificial Sequence
  Synthetic polynucleotide
accggtcgcaggctcgagtt

SEQ ID NO: 1518 - DNA, 20 bp, Artificial Sequence
  Synthetic polynucleotide
acctatcgcctccacgtgaa

SEQ ID NO: 1519 - DNA, 20 bp, Artificial Sequence
  Synthetic polynucleotide
agccgtcagaaggtttccac

SEQ ID NO: 1520 - DNA, 20 bp, Artificial Sequence
  Synthetic polynucleotide
tactggcttagagagtcaaa

SEQ ID NO: 1521 - DNA, 20 bp, Artificial Sequence
  Synthetic polynucleotide
gtcggccgaaactgacaggt

SEQ ID NO: 1522 - DNA, 20 bp, Artificial Sequence
  Synthetic polynucleotide
cacgctcagattcagaccaa

SEQ ID NO: 1523 - DNA, 20 bp, Artificial Sequence
  Synthetic polynucleotide
gcgactcgcaagaactgggc

SEQ ID NO: 1524 - DNA, 20 bp, Artificial Sequence
  Synthetic polynucleotide
tatgggctcccgcgtcttca

SEQ ID NO: 1525 - DNA, 20 bp, Artificial Sequence
  Synthetic polynucleotide
cggcctcggcgagagtttat

SEQ ID NO: 1526 - DNA, 20 bp, Artificial Sequence
  Synthetic polynucleotide
gccccgccgctggcggcctt

SEQ ID NO: 1527 - DNA, 20 bp, Artificial Sequence
  Synthetic polynucleotide
aaccgtccttctagtaggtt

SEQ ID NO: 1528 - DNA, 20 bp, Artificial Sequence
  Synthetic polynucleotide
gcgatgccgttccgcctact

SEQ ID NO: 1529 - DNA, 20 bp, Artificial Sequence
  Synthetic polynucleotide
gcgcgcctcgctttgctctc

SEQ ID NO: 1530 - DNA, 20 bp, Artificial Sequence
  Synthetic polynucleotide
gtgatcctgccctcgtctac

SEQ ID NO: 1531 - DNA, 20 bp, Artificial Sequence
  Synthetic polynucleotide
gagcggcgcaccgaaagaat

SEQ ID NO: 1532 - DNA, 20 bp, Artificial Sequence
  Synthetic polynucleotide
ctaacgctgagtatgtggcg

SEQ ID NO: 1533 - DNA, 20 bp, Artificial Sequence
  Synthetic polynucleotide
gcacctcgcgctaaccaaga

SEQ ID NO: 1534 - DNA, 20 bp, Artificial Sequence
  Synthetic polynucleotide
acgatccatgcgatagctgt

SEQ ID NO: 1535 - DNA, 20 bp, Artificial Sequence
  Synthetic polynucleotide
caaccgcggctacatatgtc

SEQ ID NO: 1536 - DNA, 20 bp, Artificial Sequence
  Synthetic polynucleotide
gtgaccctctaagttgcgac

SEQ ID NO: 1537 - DNA, 20 bp, Artificial Sequence
  Synthetic polynucleotide
agcgtgcccgaaatccggga

SEQ ID NO: 1538 - DNA, 20 bp, Artificial Sequence
  Synthetic polynucleotide
ctggcccacatactcccggc

SEQ ID NO: 1539 - DNA, 20 bp, Artificial Sequence
  Synthetic polynucleotide
ataaaactatttatttaaaa

SEQ ID NO: 1540 - DNA, 20 bp, Artificial Sequence
  Synthetic polynucleotide
atttctcttacgtctaatat

SEQ ID NO: 1541 - DNA, 20 bp, Artificial Sequence
  Synthetic polynucleotide
cccattcacatactataaat

SEQ ID NO: 1542 - DNA, 20 bp, Artificial Sequence
  Synthetic polynucleotide
ctagctcatcattgttctta

SEQ ID NO: 1543 - DNA, 20 bp, Artificial Sequence
  Synthetic polynucleotide
atttagcctgtgtaaaattg

SEQ ID NO: 1544 - DNA, 20 bp, Artificial Sequence
  Synthetic polynucleotide
agaattctgttgtgaaatta

SEQ ID NO: 1545 - DNA, 20 bp, Artificial Sequence
  Synthetic polynucleotide
agtcagctagcaagaaaaac

SEQ ID NO: 1546 - DNA, 20 bp, Artificial Sequence
  Synthetic polynucleotide
gtaggactttattaataaga

SEQ ID NO: 1547 - DNA, 20 bp, Artificial Sequence
  Synthetic polynucleotide
aaaacaccacacagtcaaaa

SEQ ID NO: 1548 - DNA, 20 bp, Artificial Sequence
  Synthetic polynucleotide
gaagatcgaaatataaaccg

SEQ ID NO: 1549 - DNA, 20 bp, Artificial Sequence
  Synthetic polynucleotide
aagtcccattagaattagtc

SEQ ID NO: 1550 - DNA, 20 bp, Artificial Sequence
  Synthetic polynucleotide
tatatacactgtataatgtt

SEQ ID NO: 1551 - DNA, 20 bp, Artificial Sequence
  Synthetic polynucleotide
cacatgctgataataaagga

SEQ ID NO: 1552 - DNA, 20 bp, Artificial Sequence
  Synthetic polynucleotide
attcgtcaaaaatacctaga

SEQ ID NO: 1553 - DNA, 20 bp, Artificial Sequence
  Synthetic polynucleotide
atttgacaaaacatatcaga

SEQ ID NO: 1554 - DNA, 20 bp, Artificial Sequence
  Synthetic polynucleotide
ctctcacgtttaaagttgct

SEQ ID NO: 1555 - DNA, 20 bp, Artificial Sequence
  Synthetic polynucleotide
cctatacggttgtaatatct

SEQ ID NO: 1556 - DNA, 20 bp, Artificial Sequence
  Synthetic polynucleotide
tcgtcgcgcatgtttgttct

SEQ ID NO: 1557 - DNA, 20 bp, Artificial Sequence
  Synthetic polynucleotide
ggttagcaacaccataaatg

SEQ ID NO: 1558 - DNA, 20 bp, Artificial Sequence
  Synthetic polynucleotide
aaagaacagtcgagataaaa

SEQ ID NO: 1559 - DNA, 20 bp, Artificial Sequence
  Synthetic polynucleotide
ctgattcggagaattaaaaa

SEQ ID NO: 1560 - DNA, 20 bp, Artificial Sequence
  Synthetic polynucleotide
aggttgcacagtgttagaat

SEQ ID NO: 1561 - DNA, 20 bp, Artificial Sequence
  Synthetic polynucleotide
ggtttgccctaaatacgtta

SEQ ID NO: 1562 - DNA, 20 bp, Artificial Sequence
  Synthetic polynucleotide
ggacgactatcatccatctt

SEQ ID NO: 1563 - DNA, 20 bp, Artificial Sequence
  Synthetic polynucleotide
gggagactgacgttatcgat

SEQ ID NO: 1564 - DNA, 20 bp, Artificial Sequence
  Synthetic polynucleotide
aagagccaactcgtaatgag

SEQ ID NO: 1565 - DNA, 20 bp, Artificial Sequence
  Synthetic polynucleotide
gtgatgcatgacaatcatag

SEQ ID NO: 1566 - DNA, 20 bp, Artificial Sequence
  Synthetic polynucleotide
gaaggtccctctcactccga

SEQ ID NO: 1567 - DNA, 20 bp, Artificial Sequence
  Synthetic polynucleotide
ttgggaccagattatcatgg

SEQ ID NO: 1568 - DNA, 20 bp, Artificial Sequence
  Synthetic polynucleotide
gaagatcagtcttccagagg

SEQ ID NO: 1569 - DNA, 20 bp, Artificial Sequence
  Synthetic polynucleotide
tgggcgcttattgcctttat

SEQ ID NO: 1570 - DNA, 20 bp, Artificial Sequence
  Synthetic polynucleotide
accgcccgcgctagtattct

SEQ ID NO: 1571 - DNA, 20 bp, Artificial Sequence
  Synthetic polynucleotide
gtcttaccgttctatattta

SEQ ID NO: 1572 - DNA, 20 bp, Artificial Sequence
  Synthetic polynucleotide
aggcctcattgtacctcttt

SEQ ID NO: 1573 - DNA, 20 bp, Artificial Sequence
  Synthetic polynucleotide
tgcaaacggtgtaagattat

SEQ ID NO: 1574 - DNA, 20 bp, Artificial Sequence
  Synthetic polynucleotide
aaaaggctaaattcataaca

SEQ ID NO: 1575 - DNA, 20 bp, Artificial Sequence
  Synthetic polynucleotide
ttgtatcgcaaacaaaagag

SEQ ID NO: 1576 - DNA, 20 bp, Artificial Sequence
  Synthetic polynucleotide
atcccacgtttgatctgtta

SEQ ID NO: 1577 - DNA, 20 bp, Artificial Sequence
  Synthetic polynucleotide
tttccaccaagtagtgaatc

SEQ ID NO: 1578 - DNA, 20 bp, Artificial Sequence
  Synthetic polynucleotide
gagagaccaatctctcagag

SEQ ID NO: 1579 - DNA, 20 bp, Artificial Sequence
  Synthetic polynucleotide
tggtttcttgcaaacagccc

SEQ ID NO: 1580 - DNA, 20 bp, Artificial Sequence
  Synthetic polynucleotide
taagacctgcatcgattggg

SEQ ID NO: 1581 - DNA, 20 bp, Artificial Sequence
  Synthetic polynucleotide
aaatagctaatgggttccgc

SEQ ID NO: 1582 - DNA, 20 bp, Artificial Sequence
  Synthetic polynucleotide
gtagaacggtacgaccgagg

SEQ ID NO: 1583 - DNA, 20 bp, Artificial Sequence
  Synthetic polynucleotide
gagggtccaatgaatcgagg

SEQ ID NO: 1584 - DNA, 20 bp, Artificial Sequence
  Synthetic polynucleotide
gggtcaccctctagttatat

SEQ ID NO: 1585 - DNA, 20 bp, Artificial Sequence
  Synthetic polynucleotide
agtgggctttggccgattct

SEQ ID NO: 1586 - DNA, 20 bp, Artificial Sequence
  Synthetic polynucleotide
gcttctctgtttctctcttt

SEQ ID NO: 1587 - DNA, 20 bp, Artificial Sequence
  Synthetic polynucleotide
ggtaccctgtcagactttag

SEQ ID NO: 1588 - DNA, 20 bp, Artificial Sequence
  Synthetic polynucleotide
tggtgtcggtgttcttctta

SEQ ID NO: 1589 - DNA, 20 bp, Artificial Sequence
  Synthetic polynucleotide
atcggtctcagagatttaat

SEQ ID NO: 1590 - DNA, 20 bp, Artificial Sequence
  Synthetic polynucleotide
gcccgccgaccctgatccta

SEQ ID NO: 1591 - DNA, 20 bp, Artificial Sequence
  Synthetic polynucleotide
gtatcactcgataatcgttg

SEQ ID NO: 1592 - DNA, 20 bp, Artificial Sequence
  Synthetic polynucleotide
caggtgctgatcgagctccc

SEQ ID NO: 1593 - DNA, 20 bp, Artificial Sequence
  Synthetic polynucleotide
gctgcccagagtataccctg

SEQ ID NO: 1594 - DNA, 20 bp, Artificial Sequence
  Synthetic polynucleotide
tcttcgcgaaccacaaagga

SEQ ID NO: 1595 - DNA, 20 bp, Artificial Sequence
  Synthetic polynucleotide
actctgccaattcgacgggg

SEQ ID NO: 1596 - DNA, 20 bp, Artificial Sequence
  Synthetic polynucleotide
cgcccacaggactgtaacga

SEQ ID NO: 1597 - DNA, 20 bp, Artificial Sequence
  Synthetic polynucleotide
aagcgtcgtcagtatacggc

SEQ ID NO: 1598 - DNA, 20 bp, Artificial Sequence
  Synthetic polynucleotide
cgggtacagacttgatacgc

SEQ ID NO: 1599 - DNA, 20 bp, Artificial Sequence
  Synthetic polynucleotide
actcaccttgagcttgcttt

SEQ ID NO: 1600 - DNA, 20 bp, Artificial Sequence
  Synthetic polynucleotide
ccaaggcggtaacgtattcc

SEQ ID NO: 1601 - DNA, 20 bp, Artificial Sequence
  Synthetic polynucleotide
gcgatccggtagcttaattt

SEQ ID NO: 1602 - DNA, 20 bp, Artificial Sequence
  Synthetic polynucleotide
tggagccgcttagcattgtt

SEQ ID NO: 1603 - DNA, 20 bp, Artificial Sequence
  Synthetic polynucleotide
tggtgccgtttgattgccct

SEQ ID NO: 1604 - DNA, 20 bp, Artificial Sequence
  Synthetic polynucleotide
tcgcgaccgcgaacaagtct

SEQ ID NO: 1605 - DNA, 20 bp, Artificial Sequence
  Synthetic polynucleotide
agggctctccattccaaaac

SEQ ID NO: 1606 - DNA, 20 bp, Artificial Sequence
  Synthetic polynucleotide
gtgacgccgcccagctcgtt

SEQ ID NO: 1607 - DNA, 20 bp, Artificial Sequence
  Synthetic polynucleotide
tgaggcccggctgcttacaa

SEQ ID NO: 1608 - DNA, 20 bp, Artificial Sequence
  Synthetic polynucleotide
ccccacctaccagccagaaa

SEQ ID NO: 1609 - DNA, 20 bp, Artificial Sequence
  Synthetic polynucleotide
ccactgcacgccaaccggag

SEQ ID NO: 1610 - DNA, 20 bp, Artificial Sequence
  Synthetic polynucleotide
cgtcgaccgtgtgtatgggc

SEQ ID NO: 1611 - DNA, 20 bp, Artificial Sequence
  Synthetic polynucleotide
gagtggccccttctcaaaga

SEQ ID NO: 1612 - DNA, 20 bp, Artificial Sequence
  Synthetic polynucleotide
ggagcacttcagaaccccgg

SEQ ID NO: 1613 - DNA, 20 bp, Artificial Sequence
  Synthetic polynucleotide
ccgagtctctcatgcacaga

SEQ ID NO: 1614 - DNA, 20 bp, Artificial Sequence
  Synthetic polynucleotide
atttaacgggatttatattt

SEQ ID NO: 1615 - DNA, 20 bp, Artificial Sequence
  Synthetic polynucleotide
taacaacaggaacaataaaa

SEQ ID NO: 1616 - DNA, 20 bp, Artificial Sequence
  Synthetic polynucleotide
ttaattctatatggtattaa

SEQ ID NO: 1617 - DNA, 20 bp, Artificial Sequence
  Synthetic polynucleotide
ttaaaactgggcagttaagg

SEQ ID NO: 1618 - DNA, 20 bp, Artificial Sequence
  Synthetic polynucleotide
ttaaaacataaaggaaataa

SEQ ID NO: 1619 - DNA, 20 bp, Artificial Sequence
  Synthetic polynucleotide
atagtgcatataaaggatta

SEQ ID NO: 1620 - DNA, 20 bp, Artificial Sequence
  Synthetic polynucleotide
ttaatacgtagtttggtgta

SEQ ID NO: 1621 - DNA, 20 bp, Artificial Sequence
  Synthetic polynucleotide
agtcatctgagaaagggtaa

SEQ ID NO: 1622 - DNA, 20 bp, Artificial Sequence
  Synthetic polynucleotide
atatatccaggggacgagta

SEQ ID NO: 1623 - DNA, 20 bp, Artificial Sequence
  Synthetic polynucleotide
tgtacacagaatcgggggtg

SEQ ID NO: 1624 - DNA, 20 bp, Artificial Sequence
  Synthetic polynucleotide
cgttgtcaaagaagaatgaa

SEQ ID NO: 1625 - DNA, 20 bp, Artificial Sequence
  Synthetic polynucleotide
gagagtcgtgcattgtgtgt

SEQ ID NO: 1626 - DNA, 20 bp, Artificial Sequence
  Synthetic polynucleotide
gaataccagtaaaggacaaa

SEQ ID NO: 1627 - DNA, 20 bp, Artificial Sequence
  Synthetic polynucleotide
ctaaagcggataaatgacgg

SEQ ID NO: 1628 - DNA, 20 bp, Artificial Sequence
  Synthetic polynucleotide
taaaaacattataaacgaac

SEQ ID NO: 1629 - DNA, 20 bp, Artificial Sequence
  Synthetic polynucleotide
gatgttcaattgggatattt

SEQ ID NO: 1630 - DNA, 20 bp, Artificial Sequence
  Synthetic polynucleotide
aaagttcgttggtcggttct

SEQ ID NO: 1631 - DNA, 20 bp, Artificial Sequence
  Synthetic polynucleotide
catatgcagctggggtatat

SEQ ID NO: 1632 - DNA, 20 bp, Artificial Sequence
  Synthetic polynucleotide
tgggttcgtatagtgggtgt

SEQ ID NO: 1633 - DNA, 20 bp, Artificial Sequence
  Synthetic polynucleotide
atccgtcctgttgggatttg

SEQ ID NO: 1634 - DNA, 20 bp, Artificial Sequence
  Synthetic polynucleotide
tcgtaacgaaggggtatcca

SEQ ID NO: 1635 - DNA, 20 bp, Artificial Sequence
  Synthetic polynucleotide
tacattcttggggagagtat

SEQ ID NO: 1636 - DNA, 20 bp, Artificial Sequence
  Synthetic polynucleotide
taaattcagagaatgggaat

SEQ ID NO: 1637 - DNA, 20 bp, Artificial Sequence
  Synthetic polynucleotide
cggaatccatatggggccat

SEQ ID NO: 1638 - DNA, 20 bp, Artificial Sequence
  Synthetic polynucleotide
ataggccttgaaggatagga

SEQ ID NO: 1639 - DNA, 20 bp, Artificial Sequence
  Synthetic polynucleotide
cacatccgcgatacaagaca

SEQ ID NO: 1640 - DNA, 20 bp, Artificial Sequence
  Synthetic polynucleotide
tagaagccgcaagatggaga

SEQ ID NO: 1641 - DNA, 20 bp, Artificial Sequence
  Synthetic polynucleotide
agtttgcgaggtttacaggg

SEQ ID NO: 1642 - DNA, 20 bp, Artificial Sequence
  Synthetic polynucleotide
ttaggtcgacggaaacgaga

SEQ ID NO: 1643 - DNA, 20 bp, Artificial Sequence
  Synthetic polynucleotide
atcgcgcataataggctggc

SEQ ID NO: 1644 - DNA, 20 bp, Artificial Sequence
  Synthetic polynucleotide
gtagggctatgctgggctct

SEQ ID NO: 1645 - DNA, 20 bp, Artificial Sequence
  Synthetic polynucleotide
cgggatctgggcaaatttct

SEQ ID NO: 1646 - DNA, 20 bp, Artificial Sequence
  Synthetic polynucleotide
aattctccaatggggctttg

SEQ ID NO: 1647 - DNA, 20 bp, Artificial Sequence
  Synthetic polynucleotide
tacaatctacgtggggaatt

SEQ ID NO: 1648 - DNA, 20 bp, Artificial Sequence
  Synthetic polynucleotide
taaacgctgggggatctatt

SEQ ID NO: 1649 - DNA, 20 bp, Artificial Sequence
  Synthetic polynucleotide
gggactcttcttgcttgtct

SEQ ID NO: 1650 - DNA, 20 bp, Artificial Sequence
  Synthetic polynucleotide
caattactgtggggagcaca

SEQ ID NO: 1651 - DNA, 20 bp, Artificial Sequence
  Synthetic polynucleotide
tggtttccctcgtgggtggg

SEQ ID NO: 1652 - DNA, 20 bp, Artificial Sequence
  Synthetic polynucleotide
cctgaacgggcatattgacg

SEQ ID NO: 1653 - DNA, 20 bp, Artificial Sequence
  Synthetic polynucleotide
tggcgacgcaacaggtgaac

SEQ ID NO: 1654 - DNA, 20 bp, Artificial Sequence
  Synthetic polynucleotide
taggttccctatcgtggtgt

SEQ ID NO: 1655 - DNA, 20 bp, Artificial Sequence
  Synthetic polynucleotide
aacgggctgagaaagatgaa

SEQ ID NO: 1656 - DNA, 20 bp, Artificial Sequence
  Synthetic polynucleotide
tacggacggctaagaacaga

SEQ ID NO: 1657 - DNA, 20 bp, Artificial Sequence
  Synthetic polynucleotide
gacatcctggactggaccac

SEQ ID NO: 1658 - DNA, 20 bp, Artificial Sequence
  Synthetic polynucleotide
taaacactttagcacggcgg

SEQ ID NO: 1659 - DNA, 20 bp, Artificial Sequence
  Synthetic polynucleotide
cggcgacggagggcactcct

SEQ ID NO: 1660 - DNA, 20 bp, Artificial Sequence
  Synthetic polynucleotide
gtcggtcgggggcataaatg

SEQ ID NO: 1661 - DNA, 20 bp, Artificial Sequence
  Synthetic polynucleotide
ggaggtcggcgggcctgcct

SEQ ID NO: 1662 - DNA, 20 bp, Artificial Sequence
  Synthetic polynucleotide
tggtcccgggtagggcgatt

SEQ ID NO: 1663 - DNA, 20 bp, Artificial Sequence
  Synthetic polynucleotide
taatctctgccacgggttac

SEQ ID NO: 1664 - DNA, 20 bp, Artificial Sequence
  Synthetic polynucleotide
tattaccgagaagggccttc

SEQ ID NO: 1665 - DNA, 20 bp, Artificial Sequence
  Synthetic polynucleotide
aatgggcgtcaaccaggctc

SEQ ID NO: 1666 - DNA, 20 bp, Artificial Sequence
  Synthetic polynucleotide
tgctaacgtcccaagctccc

SEQ ID NO: 1667 - DNA, 20 bp, Artificial Sequence
  Synthetic polynucleotide
aatcctcttcggggccatgg

SEQ ID NO: 1668 - DNA, 20 bp, Artificial Sequence
  Synthetic polynucleotide
ctagcacgtcggcgacagaa

SEQ ID NO: 1669 - DNA, 20 bp, Artificial Sequence
  Synthetic polynucleotide
taaggacaccatgttggagt

SEQ ID NO: 1670 - DNA, 20 bp, Artificial Sequence
  Synthetic polynucleotide
taaagcctaagatacgcgcg

SEQ ID NO: 1671 - DNA, 20 bp, Artificial Sequence
  Synthetic polynucleotide
actactcaagccatgagagc

SEQ ID NO: 1672 - DNA, 20 bp, Artificial Sequence
  Synthetic polynucleotide
atagacccacattcgcgagc

SEQ ID NO: 1673 - DNA, 20 bp, Artificial Sequence
  Synthetic polynucleotide
agtcggcacgaagatcacga

SEQ ID NO: 1674 - DNA, 20 bp, Artificial Sequence
  Synthetic polynucleotide
tgtcagcccgggtcatttcc

SEQ ID NO: 1675 - DNA, 20 bp, Artificial Sequence
  Synthetic polynucleotide
ggcggccgcgccgagcgcga

SEQ ID NO: 1676 - DNA, 20 bp, Artificial Sequence
  Synthetic polynucleotide
gacgggctgccgggcctttg

SEQ ID NO: 1677 - DNA, 20 bp, Artificial Sequence
  Synthetic polynucleotide
gcgtggctaacgcggggtat

SEQ ID NO: 1678 - DNA, 20 bp, Artificial Sequence
  Synthetic polynucleotide
gatcgacctgtctcgggtct

SEQ ID NO: 1679 - DNA, 20 bp, Artificial Sequence
  Synthetic polynucleotide
acgatccccccacctagtct

SEQ ID NO: 1680 - DNA, 20 bp, Artificial Sequence
  Synthetic polynucleotide
cagtgtcgttcctccctccc

SEQ ID NO: 1681 - DNA, 20 bp, Artificial Sequence
  Synthetic polynucleotide
cccaaccagcaccaggggct

SEQ ID NO: 1682 - DNA, 20 bp, Artificial Sequence
  Synthetic polynucleotide
gggacgcggcacaaacaaac

SEQ ID NO: 1683 - DNA, 20 bp, Artificial Sequence
  Synthetic polynucleotide
tagaggcgtgcagacgcaga

SEQ ID NO: 1684 - DNA, 20 bp, Artificial Sequence
  Synthetic polynucleotide
tgaacgcaacggcgcgaccg

SEQ ID NO: 1685 - DNA, 20 bp, Artificial Sequence
  Synthetic polynucleotide
gataggcttgtggcgccggg

SEQ ID NO: 1686 - DNA, 20 bp, Artificial Sequence
  Synthetic polynucleotide
cgttgactatggtacgccgc

SEQ ID NO: 1687 - DNA, 20 bp, Artificial Sequence
  Synthetic polynucleotide
agctcccggacacggtgagg

SEQ ID NO: 1688 - DNA, 20 bp, Artificial Sequence
  Synthetic polynucleotide
cagaggcttcggttgccagc

SEQ ID NO: 1689 - DNA, 20 bp, Artificial Sequence
  Synthetic polynucleotide
gttgggctggtaattaaaaa

SEQ ID NO: 1690 - DNA, 20 bp, Artificial Sequence
  Synthetic polynucleotide
atttgactgggtaaattatt

SEQ ID NO: 1691 - DNA, 20 bp, Artificial Sequence
  Synthetic polynucleotide
ttataacaatataataaata

SEQ ID NO: 1692 - DNA, 20 bp, Artificial Sequence
  Synthetic polynucleotide
ctaactctttgctggttctt

SEQ ID NO: 1693 - DNA, 20 bp, Artificial Sequence
  Synthetic polynucleotide
ataaaacgggaggaaaaaaa

SEQ ID NO: 1694 - DNA, 20 bp, Artificial Sequence
  Synthetic polynucleotide
tattacctagttggatgttt

SEQ ID NO: 1695 - DNA, 20 bp, Artificial Sequence
  Synthetic polynucleotide
tttgatctataagaaataag

SEQ ID NO: 1696 - DNA, 20 bp, Artificial Sequence
  Synthetic polynucleotide
tttaaactagtgcagggacg

SEQ ID NO: 1697 - DNA, 20 bp, Artificial Sequence
  Synthetic polynucleotide
taaattcagtgaaggtaagt

SEQ ID NO: 1698 - DNA, 20 bp, Artificial Sequence
  Synthetic polynucleotide
tattaactaaaagagtgaag

SEQ ID NO: 1699 - DNA, 20 bp, Artificial Sequence
  Synthetic polynucleotide
aaaagactaaaaggttagga

SEQ ID NO: 1700 - DNA, 20 bp, Artificial Sequence
  Synthetic polynucleotide
tcgtatctaaagaaaagaag

SEQ ID NO: 1701 - DNA, 20 bp, Artificial Sequence
  Synthetic polynucleotide
aagttacaaaaggggattgc

SEQ ID NO: 1702 - DNA, 20 bp, Artificial Sequence
  Synthetic polynucleotide
tatgatcaatagaaaggaga

SEQ ID NO: 1703 - DNA, 20 bp, Artificial Sequence
  Synthetic polynucleotide
ttatatcttatagaaaacga

SEQ ID NO: 1704 - DNA, 20 bp, Artificial Sequence
  Synthetic polynucleotide
ctgcttcagactcttattct

SEQ ID NO: 1705 - DNA, 20 bp, Artificial Sequence
  Synthetic polynucleotide
ttgaatcggggagtaattag

SEQ ID NO: 1706 - DNA, 20 bp, Artificial Sequence
  Synthetic polynucleotide
ttcaatccgggcatttatta

SEQ ID NO: 1707 - DNA, 20 bp, Artificial Sequence
  Synthetic polynucleotide
ccaactcggtttccacatca

SEQ ID NO: 1708 - DNA, 20 bp, Artificial Sequence
  Synthetic polynucleotide
cgacttcggggggagagttt

SEQ ID NO: 1709 - DNA, 20 bp, Artificial Sequence
  Synthetic polynucleotide
gtttatctggaagtaagtta

SEQ ID NO: 1710 - DNA, 20 bp, Artificial Sequence
  Synthetic polynucleotide
tgcagacatataaggggatt

SEQ ID NO: 1711 - DNA, 20 bp, Artificial Sequence
  Synthetic polynucleotide
tatcatcctaatggccctcc

SEQ ID NO: 1712 - DNA, 20 bp, Artificial Sequence
  Synthetic polynucleotide
gtcatacaggacgtggttgg

SEQ ID NO: 1713 - DNA, 20 bp, Artificial Sequence
  Synthetic polynucleotide
ttattgcctggtgtgtggtg

SEQ ID NO: 1714 - DNA, 20 bp, Artificial Sequence
  Synthetic polynucleotide
gggatccggaagtcaaggaa

SEQ ID NO: 1715 - DNA, 20 bp, Artificial Sequence
  Synthetic polynucleotide
tcttgacaggggtactgcaa

SEQ ID NO: 1716 - DNA, 20 bp, Artificial Sequence
  Synthetic polynucleotide
atggaacaccacacaaccac

SEQ ID NO: 1717 - DNA, 20 bp, Artificial Sequence
  Synthetic polynucleotide
gattcgcaagggtattaggg

SEQ ID NO: 1718 - DNA, 20 bp, Artificial Sequence
  Synthetic polynucleotide
gttatgcaaggcattggagg

SEQ ID NO: 1719 - DNA, 20 bp, Artificial Sequence
  Synthetic polynucleotide
atcctgctgacagctcttct

SEQ ID NO: 1720 - DNA, 20 bp, Artificial Sequence
  Synthetic polynucleotide
attggtcgtgggccagttct

SEQ ID NO: 1721 - DNA, 20 bp, Artificial Sequence
  Synthetic polynucleotide
acgggccgctggtttagtct

SEQ ID NO: 1722 - DNA, 20 bp, Artificial Sequence
  Synthetic polynucleotide
gtatcacggtatcgtatttg

SEQ ID NO: 1723 - DNA, 20 bp, Artificial Sequence
  Synthetic polynucleotide
ttggttccgcaagagggtct

SEQ ID NO: 1724 - DNA, 20 bp, Artificial Sequence
  Synthetic polynucleotide
gttaacccagatcttgggct

SEQ ID NO: 1725 - DNA, 20 bp, Artificial Sequence
  Synthetic polynucleotide
atagaccggcgctaggtaca

SEQ ID NO: 1726 - DNA, 20 bp, Artificial Sequence
  Synthetic polynucleotide
gaattccacgtggttggttg

SEQ ID NO: 1727 - DNA, 20 bp, Artificial Sequence
  Synthetic polynucleotide
tgacagcatgggaagagatg

SEQ ID NO: 1728 - DNA, 20 bp, Artificial Sequence
  Synthetic polynucleotide
tgtccgcgtggaaaagtgag

SEQ ID NO: 1729 - DNA, 20 bp, Artificial Sequence
  Synthetic polynucleotide
gttacaccctcaaggtgagc

SEQ ID NO: 1730 - DNA, 20 bp, Artificial Sequence
  Synthetic polynucleotide
ttgcgcctttggaggagtga

SEQ ID NO: 1731 - DNA, 20 bp, Artificial Sequence
  Synthetic polynucleotide
tttgttcaggagaagatgga

SEQ ID NO: 1732 - DNA, 20 bp, Artificial Sequence
  Synthetic polynucleotide
ataggtcataagacccgcac

SEQ ID NO: 1733 - DNA, 20 bp, Artificial Sequence
  Synthetic polynucleotide
tttgatctgagtgtcagaga

SEQ ID NO: 1734 - DNA, 20 bp, Artificial Sequence
  Synthetic polynucleotide
gctcggctggtctgctgtct

SEQ ID NO: 1735 - DNA, 20 bp, Artificial Sequence
  Synthetic polynucleotide
tttcgtcgtgggggtattca

SEQ ID NO: 1736 - DNA, 20 bp, Artificial Sequence
  Synthetic polynucleotide
gctgggcgattacggcaacg

SEQ ID NO: 1737 - DNA, 20 bp, Artificial Sequence
  Synthetic polynucleotide
gcgcgcccaacagggctgct

SEQ ID NO: 1738 - DNA, 20 bp, Artificial Sequence
  Synthetic polynucleotide
gctggcccgaccgtagggct

SEQ ID NO: 1739 - DNA, 20 bp, Artificial Sequence
  Synthetic polynucleotide
agacaccccacaggggggcc

SEQ ID NO: 1740 - DNA, 20 bp, Artificial Sequence
  Synthetic polynucleotide
cttcgcccaccctttccgcc

SEQ ID NO: 1741 - DNA, 20 bp, Artificial Sequence
  Synthetic polynucleotide
cagcgaccttccctatcccc

SEQ ID NO: 1742 - DNA, 20 bp, Artificial Sequence
  Synthetic polynucleotide
gagaaacagggggtatggaa

SEQ ID NO: 1743 - DNA, 20 bp, Artificial Sequence
  Synthetic polynucleotide
tatccccagcggtgtgtcgg

SEQ ID NO: 1744 - DNA, 20 bp, Artificial Sequence
  Synthetic polynucleotide
catacccccggagatcgaac

SEQ ID NO: 1745 - DNA, 20 bp, Artificial Sequence
  Synthetic polynucleotide
tctctgctgggacgcccgga

SEQ ID NO: 1746 - DNA, 20 bp, Artificial Sequence
  Synthetic polynucleotide
agagggcgctatagcagggg

SEQ ID NO: 1747 - DNA, 20 bp, Artificial Sequence
  Synthetic polynucleotide
taccgactgtcctgcaccac

SEQ ID NO: 1748 - DNA, 20 bp, Artificial Sequence
  Synthetic polynucleotide
tggacacaagtatgcggggg

SEQ ID NO: 1749 - DNA, 20 bp, Artificial Sequence
  Synthetic polynucleotide
gcccgtcgggtgcgctcgct

SEQ ID NO: 1750 - DNA, 20 bp, Artificial Sequence
  Synthetic polynucleotide
tggcttccggcggctggttt

SEQ ID NO: 1751 - DNA, 20 bp, Artificial Sequence
  Synthetic polynucleotide
gctgccccggttggcttcca

SEQ ID NO: 1752 - DNA, 20 bp, Artificial Sequence
  Synthetic polynucleotide
tcgtgacggctggtgggtgc

SEQ ID NO: 1753 - DNA, 20 bp, Artificial Sequence
  Synthetic polynucleotide
aggggccctggccctgccta

SEQ ID NO: 1754 - DNA, 20 bp, Artificial Sequence
  Synthetic polynucleotide
tttaggcgggggtggtctcc

SEQ ID NO: 1755 - DNA, 20 bp, Artificial Sequence
  Synthetic polynucleotide
tggctcccacgccatggccg

SEQ ID NO: 1756 - DNA, 20 bp, Artificial Sequence
  Synthetic polynucleotide
accatgcggaacctcaggcg

SEQ ID NO: 1757 - DNA, 20 bp, Artificial Sequence
  Synthetic polynucleotide
attgaaccgtgtgagggccc

SEQ ID NO: 1758 - DNA, 20 bp, Artificial Sequence
  Synthetic polynucleotide
cgttagcgcgaccgtggaac

SEQ ID NO: 1759 - DNA, 20 bp, Artificial Sequence
  Synthetic polynucleotide
cattcccgcggaaggcacgc

SEQ ID NO: 1760 - DNA, 20 bp, Artificial Sequence
  Synthetic polynucleotide
taaaagccccccggctccgg

SEQ ID NO: 1761 - DNA, 20 bp, Artificial Sequence
  Synthetic polynucleotide
gaggtccgagacgtctccgt

SEQ ID NO: 1762 - DNA, 20 bp, Artificial Sequence
  Synthetic polynucleotide
tcgatccgaggtatcccggg

SEQ ID NO: 1763 - DNA, 20 bp, Artificial Sequence
  Synthetic polynucleotide
gtcggccaggtggtaacagg

SEQ ID NO: 1764 - DNA, 20 bp, Artificial Sequence
  Synthetic polynucleotide
tatttaccaatgtattattt

SEQ ID NO: 1765 - DNA, 20 bp, Artificial Sequence
  Synthetic polynucleotide
cattaactattaaataaatt

SEQ ID NO: 1766 - DNA, 20 bp, Artificial Sequence
  Synthetic polynucleotide
tttgtgctttattcttattt

SEQ ID NO: 1767 - DNA, 20 bp, Artificial Sequence
  Synthetic polynucleotide
aaaaaactgaaaacaattat

SEQ ID NO: 1768 - DNA, 20 bp, Artificial Sequence
  Synthetic polynucleotide
tcttatctcttctgagatct

SEQ ID NO: 1769 - DNA, 20 bp, Artificial Sequence
  Synthetic polynucleotide
caaggacaattaaaaaataa

SEQ ID NO: 1770 - DNA, 20 bp, Artificial Sequence
  Synthetic polynucleotide
caaagacatgatatataact

SEQ ID NO: 1771 - DNA, 20 bp, Artificial Sequence
  Synthetic polynucleotide
ggaggtcagggaagtttcat

SEQ ID NO: 1772 - DNA, 20 bp, Artificial Sequence
  Synthetic polynucleotide
tgaatacttgttgttatgtt

SEQ ID NO: 1773 - DNA, 20 bp, Artificial Sequence
  Synthetic polynucleotide
ggttagcgaaatgaatgaat

SEQ ID NO: 1774 - DNA, 20 bp, Artificial Sequence
  Synthetic polynucleotide
atcgaacgaaaaactaacta

SEQ ID NO: 1775 - DNA, 20 bp, Artificial Sequence
  Synthetic polynucleotide
tagaaacaaaaactacgcaa

SEQ ID NO: 1776 - DNA, 20 bp, Artificial Sequence
  Synthetic polynucleotide
tgtgtgctatggttaaggga

SEQ ID NO: 1777 - DNA, 20 bp, Artificial Sequence
  Synthetic polynucleotide
ccctgtctaaggttaacagt

SEQ ID NO: 1778 - DNA, 20 bp, Artificial Sequence
  Synthetic polynucleotide
ctaacacgaaaaaaaccaac

SEQ ID NO: 1779 - DNA, 20 bp, Artificial Sequence
  Synthetic polynucleotide
tagcaaccgaggggttattt

SEQ ID NO: 1780 - DNA, 20 bp, Artificial Sequence
  Synthetic polynucleotide
atgaatcggtttgtttattt

SEQ ID NO: 1781 - DNA, 20 bp, Artificial Sequence
  Synthetic polynucleotide
aacgcactggctgcctttaa

SEQ ID NO: 1782 - DNA, 20 bp, Artificial Sequence
  Synthetic polynucleotide
gtatgcctgtatgaggcttg

SEQ ID NO: 1783 - DNA, 20 bp, Artificial Sequence
  Synthetic polynucleotide
tggccgcaaaaacgtattat

SEQ ID NO: 1784 - DNA, 20 bp, Artificial Sequence
  Synthetic polynucleotide
tttgtgcatgattctgtctt

SEQ ID NO: 1785 - DNA, 20 bp, Artificial Sequence
  Synthetic polynucleotide
tgcactcctagaagagaaat

SEQ ID NO: 1786 - DNA, 20 bp, Artificial Sequence
  Synthetic polynucleotide
taatagccgatacgaaaacc

SEQ ID NO: 1787 - DNA, 20 bp, Artificial Sequence
  Synthetic polynucleotide
tctacactaaaacaaggacg

SEQ ID NO: 1788 - DNA, 20 bp, Artificial Sequence
  Synthetic polynucleotide
ataaaactcctatcctcacc

SEQ ID NO: 1789 - DNA, 20 bp, Artificial Sequence
  Synthetic polynucleotide
ttcgcgcaactggatagcaa

SEQ ID NO: 1790 - DNA, 20 bp, Artificial Sequence
  Synthetic polynucleotide
caatttcaagatttgggtga

SEQ ID NO: 1791 - DNA, 20 bp, Artificial Sequence
  Synthetic polynucleotide
ctgggtcagacaggcaaagg

SEQ ID NO: 1792 - DNA, 20 bp, Artificial Sequence
  Synthetic polynucleotide
gatttgcagaccgacaacag

SEQ ID NO: 1793 - DNA, 20 bp, Artificial Sequence
  Synthetic polynucleotide
attgtacagggtcagacgag

SEQ ID NO: 1794 - DNA, 20 bp, Artificial Sequence
  Synthetic polynucleotide
gctgttcgctgaaggggctt

SEQ ID NO: 1795 - DNA, 20 bp, Artificial Sequence
  Synthetic polynucleotide
ggccatcatgaggatattta

SEQ ID NO: 1796 - DNA, 20 bp, Artificial Sequence
  Synthetic polynucleotide
gcggttctgcctcgtcattt

SEQ ID NO: 1797 - DNA, 20 bp, Artificial Sequence
  Synthetic polynucleotide
aagagtctagcggcaaatag

SEQ ID NO: 1798 - DNA, 20 bp, Artificial Sequence
  Synthetic polynucleotide
ggctaacaggtaggggtgct

SEQ ID NO: 1799 - DNA, 20 bp, Artificial Sequence
  Synthetic polynucleotide
acctttcgtggtctaatcct

SEQ ID NO: 1800 - DNA, 20 bp, Artificial Sequence
  Synthetic polynucleotide
tcggtgcggtaatcaggttc

SEQ ID NO: 1801 - DNA, 20 bp, Artificial Sequence
  Synthetic polynucleotide
catgcgccattcgaggtgcc

SEQ ID NO: 1802 - DNA, 20 bp, Artificial Sequence
  Synthetic polynucleotide
tctagtcagttgggcatgta

SEQ ID NO: 1803 - DNA, 20 bp, Artificial Sequence
  Synthetic polynucleotide
ggacctcagccctacagaca

SEQ ID NO: 1804 - DNA, 20 bp, Artificial Sequence
  Synthetic polynucleotide
acgggacagcaggatcaaga

SEQ ID NO: 1805 - DNA, 20 bp, Artificial Sequence
  Synthetic polynucleotide
ttggtgctaatacgcttcgg

SEQ ID NO: 1806 - DNA, 20 bp, Artificial Sequence
  Synthetic polynucleotide
taaacgcaagggttcccggc

SEQ ID NO: 1807 - DNA, 20 bp, Artificial Sequence
  Synthetic polynucleotide
aacaaacacaactacacaag

SEQ ID NO: 1808 - DNA, 20 bp, Artificial Sequence
  Synthetic polynucleotide
gggatccaggtagtcaaagg

SEQ ID NO: 1809 - DNA, 20 bp, Artificial Sequence
  Synthetic polynucleotide
aaacttcaggccgctcttcc

SEQ ID NO: 1810 - DNA, 20 bp, Artificial Sequence
  Synthetic polynucleotide
ctggcgcggaatcgccttct

SEQ ID NO: 1811 - DNA, 20 bp, Artificial Sequence
  Synthetic polynucleotide
atggagcgccttgcgcttta

SEQ ID NO: 1812 - DNA, 20 bp, Artificial Sequence
  Synthetic polynucleotide
ctggaacctgtcgactgcct

SEQ ID NO: 1813 - DNA, 20 bp, Artificial Sequence
  Synthetic polynucleotide
cggctgctcggaactgtgct

SEQ ID NO: 1814 - DNA, 20 bp, Artificial Sequence
  Synthetic polynucleotide
cttcgtctttgaggcttacg

SEQ ID NO: 1815 - DNA, 20 bp, Artificial Sequence
  Synthetic polynucleotide
gcgaaacgcatcacaccgcc

SEQ ID NO: 1816 - DNA, 20 bp, Artificial Sequence
  Synthetic polynucleotide
taggtactacagcgcgtact

SEQ ID NO: 1817 - DNA, 20 bp, Artificial Sequence
  Synthetic polynucleotide
cctagtcccaaactggcgca

SEQ ID NO: 1818 - DNA, 20 bp, Artificial Sequence
  Synthetic polynucleotide
cgttgtcgagactgatcgcg

SEQ ID NO: 1819 - DNA, 20 bp, Artificial Sequence
  Synthetic polynucleotide
acgacacctagtggcaagtt

SEQ ID NO: 1820 - DNA, 20 bp, Artificial Sequence
  Synthetic polynucleotide
tgagcgctcccgacccggag

SEQ ID NO: 1821 - DNA, 20 bp, Artificial Sequence
  Synthetic polynucleotide
tagagacattccagtgcagc

SEQ ID NO: 1822 - DNA, 20 bp, Artificial Sequence
  Synthetic polynucleotide
tatagccgatataccgctga

SEQ ID NO: 1823 - DNA, 20 bp, Artificial Sequence
  Synthetic polynucleotide
gaccctcggatacggacagg

SEQ ID NO: 1824 - DNA, 20 bp, Artificial Sequence
  Synthetic polynucleotide
ggcagccccgcggcgccgct

SEQ ID NO: 1825 - DNA, 20 bp, Artificial Sequence
  Synthetic polynucleotide
cacctgcgcgttgagtttcg

SEQ ID NO: 1826 - DNA, 20 bp, Artificial Sequence
  Synthetic polynucleotide
atccgtctggcctgccttct

SEQ ID NO: 1827 - DNA, 20 bp, Artificial Sequence
  Synthetic polynucleotide
gccgcgcgcgactggagtct

SEQ ID NO: 1828 - DNA, 20 bp, Artificial Sequence
  Synthetic polynucleotide
tccgtccacctacgctgctt

SEQ ID NO: 1829 - DNA, 20 bp, Artificial Sequence
  Synthetic polynucleotide
cagcgtcgcggccgctattc

SEQ ID NO: 1830 - DNA, 20 bp, Artificial Sequence
  Synthetic polynucleotide
ttggagcgtctacctggcag

SEQ ID NO: 1831 - DNA, 20 bp, Artificial Sequence
  Synthetic polynucleotide
acccaacccgcggtggcaca

SEQ ID NO: 1832 - DNA, 20 bp, Artificial Sequence
  Synthetic polynucleotide
catacgctgttgcttcgccg

SEQ ID NO: 1833 - DNA, 20 bp, Artificial Sequence
  Synthetic polynucleotide
ccccagcgaatgcgctgggc

SEQ ID NO: 1834 - DNA, 20 bp, Artificial Sequence
  Synthetic polynucleotide
gggttgcgatggcgagcaga

SEQ ID NO: 1835 - DNA, 20 bp, Artificial Sequence
  Synthetic polynucleotide
gcgggtcctgacatccagtc

SEQ ID NO: 1836 - DNA, 20 bp, Artificial Sequence
  Synthetic polynucleotide
gtagtgcggaggcacagagc

SEQ ID NO: 1837 - DNA, 20 bp, Artificial Sequence
  Synthetic polynucleotide
tttaggccgaaacctgccaa

SEQ ID NO: 1838 - DNA, 20 bp, Artificial Sequence
  Synthetic polynucleotide
gtcgcgcctttaggccccgc

SEQ ID NO: 1839 - DNA, 20 bp, Artificial Sequence
  Synthetic polynucleotide
tggctactctttaaatttat

SEQ ID NO: 1840 - DNA, 20 bp, Artificial Sequence
  Synthetic polynucleotide
tgtaagcaaataattaaaaa

SEQ ID NO: 1841 - DNA, 20 bp, Artificial Sequence
  Synthetic polynucleotide
tcataacatattatttattt

SEQ ID NO: 1842 - DNA, 20 bp, Artificial Sequence
  Synthetic polynucleotide
aagggacggatttagaatta

SEQ ID NO: 1843 - DNA, 20 bp, Artificial Sequence
  Synthetic polynucleotide
aagtcgcgttgaaataaaaa

SEQ ID NO: 1844 - DNA, 20 bp, Artificial Sequence
  Synthetic polynucleotide
aaaaaacagcttattatctt

SEQ ID NO: 1845 - DNA, 20 bp, Artificial Sequence
  Synthetic polynucleotide
ttataacaaaacgaaagtaa

SEQ ID NO: 1846 - DNA, 20 bp, Artificial Sequence
  Synthetic polynucleotide
gctatactaaaaaaggtata

SEQ ID NO: 1847 - DNA, 20 bp, Artificial Sequence
  Synthetic polynucleotide
gtggttctgaaaaacaaaac

SEQ ID NO: 1848 - DNA, 20 bp, Artificial Sequence
  Synthetic polynucleotide
atttggcgttgaagagtgta

SEQ ID NO: 1849 - DNA, 20 bp, Artificial Sequence
  Synthetic polynucleotide
acaaaactaatgtagtcaaa

SEQ ID NO: 1850 - DNA, 20 bp, Artificial Sequence
  Synthetic polynucleotide
agtagtcgaaagatataagt

SEQ ID NO: 1851 - DNA, 20 bp, Artificial Sequence
  Synthetic polynucleotide
gtttcccaagaaaccaacac

SEQ ID NO: 1852 - DNA, 20 bp, Artificial Sequence
  Synthetic polynucleotide
caagaacgagataaagcaaa

SEQ ID NO: 1853 - DNA, 20 bp, Artificial Sequence
  Synthetic polynucleotide
taagagctagtaaaaaccaa

SEQ ID NO: 1854 - DNA, 20 bp, Artificial Sequence
  Synthetic polynucleotide
atgttacggccggtttaatg

SEQ ID NO: 1855 - DNA, 20 bp, Artificial Sequence
  Synthetic polynucleotide
tggggtctattgtttcgtct

SEQ ID NO: 1856 - DNA, 20 bp, Artificial Sequence
  Synthetic polynucleotide
ttaactcatgtgtctatttg

SEQ ID NO: 1857 - DNA, 20 bp, Artificial Sequence
  Synthetic polynucleotide
tcgctgctttgtatttgttc

SEQ ID NO: 1858 - DNA, 20 bp, Artificial Sequence
  Synthetic polynucleotide
gtgatgcgtgctgaataatg

SEQ ID NO: 1859 - DNA, 20 bp, Artificial Sequence
  Synthetic polynucleotide
catggcctggaagatattag

SEQ ID NO: 1860 - DNA, 20 bp, Artificial Sequence
  Synthetic polynucleotide
ttcgaccttaccgcaatgat

SEQ ID NO: 1861 - DNA, 20 bp, Artificial Sequence
  Synthetic polynucleotide
acatagcgcaagttagtaaa

SEQ ID NO: 1862 - DNA, 20 bp, Artificial Sequence
  Synthetic polynucleotide
tctactctgtcctgttcaaa

SEQ ID NO: 1863 - DNA, 20 bp, Artificial Sequence
  Synthetic polynucleotide
aaagatccaagcataagacg

SEQ ID NO: 1864 - DNA, 20 bp, Artificial Sequence
  Synthetic polynucleotide
gtgccacaaaaggaagttga

SEQ ID NO: 1865 - DNA, 20 bp, Artificial Sequence
  Synthetic polynucleotide
ttagctccaacccttcgatc

SEQ ID NO: 1866 - DNA, 20 bp, Artificial Sequence
  Synthetic polynucleotide
aagttcctaagtcaaacaga

SEQ ID NO: 1867 - DNA, 20 bp, Artificial Sequence
  Synthetic polynucleotide
gttgtacgtgacataaaggt

SEQ ID NO: 1868 - DNA, 20 bp, Artificial Sequence
  Synthetic polynucleotide
atagggcaattgaattgagg

SEQ ID NO: 1869 - DNA, 20 bp, Artificial Sequence
  Synthetic polynucleotide
tctagtccccacacctttct

SEQ ID NO: 1870 - DNA, 20 bp, Artificial Sequence
  Synthetic polynucleotide
ctcattcctggatgctttct

SEQ ID NO: 1871 - DNA, 20 bp, Artificial Sequence
  Synthetic polynucleotide
aatcagcttcttccacttca

SEQ ID NO: 1872 - DNA, 20 bp, Artificial Sequence
  Synthetic polynucleotide
taaccccgctttagttgtta

SEQ ID NO: 1873 - DNA, 20 bp, Artificial Sequence
  Synthetic polynucleotide
ttcgaaccctcctctaattc

SEQ ID NO: 1874 - DNA, 20 bp, Artificial Sequence
  Synthetic polynucleotide
gctaagctcctcatctttac

SEQ ID NO: 1875 - DNA, 20 bp, Artificial Sequence
  Synthetic polynucleotide
atgttgcagggatgtggtct

SEQ ID NO: 1876 - DNA, 20 bp, Artificial Sequence
  Synthetic polynucleotide
caaatccacctccatcgttg

SEQ ID NO: 1877 - DNA, 20 bp, Artificial Sequence
  Synthetic polynucleotide
cttggcccagaagctaggtg

SEQ ID NO: 1878 - DNA, 20 bp, Artificial Sequence
  Synthetic polynucleotide
aggggacttacatagtacaa

SEQ ID NO: 1879 - DNA, 20 bp, Artificial Sequence
  Synthetic polynucleotide
gaagttcagaacagtaaggt

SEQ ID NO: 1880 - DNA, 20 bp, Artificial Sequence
  Synthetic polynucleotide
aatctccgttaaggtccaat

SEQ ID NO: 1881 - DNA, 20 bp, Artificial Sequence
  Synthetic polynucleotide
gtaactcaatccacgacaac

SEQ ID NO: 1882 - DNA, 20 bp, Artificial Sequence
  Synthetic polynucleotide
cagtaccggagacatagagg

SEQ ID NO: 1883 - DNA, 20 bp, Artificial Sequence
  Synthetic polynucleotide
aaagggctctagaaagtgag

SEQ ID NO: 1884 - DNA, 20 bp, Artificial Sequence
  Synthetic polynucleotide
ctggggcgagtcgtgattct

SEQ ID NO: 1885 - DNA, 20 bp, Artificial Sequence
  Synthetic polynucleotide
agaggccggtcacgagttct

SEQ ID NO: 1886 - DNA, 20 bp, Artificial Sequence
  Synthetic polynucleotide
acatggcgcatctgatcttt

SEQ ID NO: 1887 - DNA, 20 bp, Artificial Sequence
  Synthetic polynucleotide
gtgcatcctcatcggttcct

SEQ ID NO: 1888 - DNA, 20 bp, Artificial Sequence
  Synthetic polynucleotide
gcgctccgtaatcagcctct

SEQ ID NO: 1889 - DNA, 20 bp, Artificial Sequence
  Synthetic polynucleotide
gggaatccctaaggtcatta

SEQ ID NO: 1890 - DNA, 20 bp, Artificial Sequence
  Synthetic polynucleotide
cgcttgcggggattaggtca

SEQ ID NO: 1891 - DNA, 20 bp, Artificial Sequence
  Synthetic polynucleotide
ctgcggcagcgggttgtcac

SEQ ID NO: 1892 - DNA, 20 bp, Artificial Sequence
  Synthetic polynucleotide
actcttctcctcgagatgtc

SEQ ID NO: 1893 - DNA, 20 bp, Artificial Sequence
  Synthetic polynucleotide
tccgccctaatagtagcgtc

SEQ ID NO: 1894 - DNA, 20 bp, Artificial Sequence
  Synthetic polynucleotide
gggcgccgccttcatactgt

SEQ ID NO: 1895 - DNA, 20 bp, Artificial Sequence
  Synthetic polynucleotide
ttatcgcgaggccccgttgt

SEQ ID NO: 1896 - DNA, 20 bp, Artificial Sequence
  Synthetic polynucleotide
ggatgactgatactcccggg

SEQ ID NO: 1897 - DNA, 20 bp, Artificial Sequence
  Synthetic polynucleotide
gactggcgacggatatccgt

SEQ ID NO: 1898 - DNA, 20 bp, Artificial Sequence
  Synthetic polynucleotide
ggctcactactgaccaacgg

SEQ ID NO: 1899 - DNA, 20 bp, Artificial Sequence
  Synthetic polynucleotide
cctcgccccgcgtcctagct

SEQ ID NO: 1900 - DNA, 20 bp, Artificial Sequence
  Synthetic polynucleotide
ggacggcccgcttgcttact

SEQ ID NO: 1901 - DNA, 20 bp, Artificial Sequence
  Synthetic polynucleotide
ctgaggctgtttggtttgca

SEQ ID NO: 1902 - DNA, 20 bp, Artificial Sequence
  Synthetic polynucleotide
aggtgaccgtcgggtgctct

SEQ ID NO: 1903 - DNA, 20 bp, Artificial Sequence
  Synthetic polynucleotide
agcttcctggccgctcgcca

SEQ ID NO: 1904 - DNA, 20 bp, Artificial Sequence
  Synthetic polynucleotide
gcagggcccccccaaaattg

SEQ ID NO: 1905 - DNA, 20 bp, Artificial Sequence
  Synthetic polynucleotide
gacgcacgcgcgaacgattt

SEQ ID NO: 1906 - DNA, 20 bp, Artificial Sequence
  Synthetic polynucleotide
tccgcccgcacgccccgaat

SEQ ID NO: 1907 - DNA, 20 bp, Artificial Sequence
  Synthetic polynucleotide
gggaagccggagctcggcac

SEQ ID NO: 1908 - DNA, 20 bp, Artificial Sequence
  Synthetic polynucleotide
caccagcctggttgagtcgc

SEQ ID NO: 1909 - DNA, 20 bp, Artificial Sequence
  Synthetic polynucleotide
ccggagccgatgtcagcgaa

SEQ ID NO: 1910 - DNA, 20 bp, Artificial Sequence
  Synthetic polynucleotide
gcaggtctacccgctccaga

SEQ ID NO: 1911 - DNA, 20 bp, Artificial Sequence
  Synthetic polynucleotide
atccaacgagtaacgtgcag

SEQ ID NO: 1912 - DNA, 20 bp, Artificial Sequence
  Synthetic polynucleotide
actcgaccagagtgccagac

SEQ ID NO: 1913 - DNA, 20 bp, Artificial Sequence
  Synthetic polynucleotide
ggcctgcccctatgaacggc

SEQ ID NO: 1914 - DNA, 20 bp, Artificial Sequence
  Synthetic polynucleotide
attaatcaaatccgttattt

SEQ ID NO: 1915 - DNA, 20 bp, Artificial Sequence
  Synthetic polynucleotide
gaattgctttactttcttta

SEQ ID NO: 1916 - DNA, 20 bp, Artificial Sequence
  Synthetic polynucleotide
tattaccactttattaattg

SEQ ID NO: 1917 - DNA, 20 bp, Artificial Sequence
  Synthetic polynucleotide
agatgacctgaaaaaaattt

SEQ ID NO: 1918 - DNA, 20 bp, Artificial Sequence
  Synthetic polynucleotide
tctctccttaaaaaataaag

SEQ ID NO: 1919 - DNA, 20 bp, Artificial Sequence
  Synthetic polynucleotide
ttgtggcatttgtagaaata

SEQ ID NO: 1920 - DNA, 20 bp, Artificial Sequence
  Synthetic polynucleotide
ttggggcagaagtaaaaaat

SEQ ID NO: 1921 - DNA, 20 bp, Artificial Sequence
  Synthetic polynucleotide
ctgggtcaatagtaagttat

SEQ ID NO: 1922 - DNA, 20 bp, Artificial Sequence
  Synthetic polynucleotide
agaatacaccactaaaaaag

SEQ ID NO: 1923 - DNA, 20 bp, Artificial Sequence
  Synthetic polynucleotide
agattacgaggtaaaactag

SEQ ID NO: 1924 - DNA, 20 bp, Artificial Sequence
  Synthetic polynucleotide
gttagtcttaaaaaaacaag

SEQ ID NO: 1925 - DNA, 20 bp, Artificial Sequence
  Synthetic polynucleotide
cttgttcacaaaaaaaatga

SEQ ID NO: 1926 - DNA, 20 bp, Artificial Sequence
  Synthetic polynucleotide
gggtttctaaaaacgaaggg

SEQ ID NO: 1927 - DNA, 20 bp, Artificial Sequence
  Synthetic polynucleotide
agtagacagttaaaaaacga

SEQ ID NO: 1928 - DNA, 20 bp, Artificial Sequence
  Synthetic polynucleotide
tgcaaacgagaaaatcgaag

SEQ ID NO: 1929 - DNA, 20 bp, Artificial Sequence
  Synthetic polynucleotide
ccttagcatactaattatat

SEQ ID NO: 1930 - DNA, 20 bp, Artificial Sequence
  Synthetic polynucleotide
tgggggctgtgcataattat

SEQ ID NO: 1931 - DNA, 20 bp, Artificial Sequence
  Synthetic polynucleotide
ggaattcatgtttcttattg

SEQ ID NO: 1932 - DNA, 20 bp, Artificial Sequence
  Synthetic polynucleotide
ttgcatcaacaatcatcttt

SEQ ID NO: 1933 - DNA, 20 bp, Artificial Sequence
  Synthetic polynucleotide
aaaaaccgcataaataaaac

SEQ ID NO: 1934 - DNA, 20 bp, Artificial Sequence
  Synthetic polynucleotide
cgagggcataaaaaaaatac

SEQ ID NO: 1935 - DNA, 20 bp, Artificial Sequence
  Synthetic polynucleotide
agaactcccctacttaaaga

SEQ ID NO: 1936 - DNA, 20 bp, Artificial Sequence
  Synthetic polynucleotide
gatgagcaaacaaagcaata

SEQ ID NO: 1937 - DNA, 20 bp, Artificial Sequence
  Synthetic polynucleotide
agatgactcccgaagaaaat

SEQ ID NO: 1938 - DNA, 20 bp, Artificial Sequence
  Synthetic polynucleotide
agatgccggtaatttgtgaa

SEQ ID NO: 1939 - DNA, 20 bp, Artificial Sequence
  Synthetic polynucleotide
aagtcactaaaatccaagaa

SEQ ID NO: 1940 - DNA, 20 bp, Artificial Sequence
  Synthetic polynucleotide
aaaaacccgtactgagcaaa

SEQ ID NO: 1941 - DNA, 20 bp, Artificial Sequence
  Synthetic polynucleotide
tacatccaagtataaagtgg

SEQ ID NO: 1942 - DNA, 20 bp, Artificial Sequence
  Synthetic polynucleotide
aacaaccttaaaacccccga

SEQ ID NO: 1943 - DNA, 20 bp, Artificial Sequence
  Synthetic polynucleotide
gcagtacgagatgactgcgt

SEQ ID NO: 1944 - DNA, 20 bp, Artificial Sequence
  Synthetic polynucleotide
tagttccaacttgcctttcg

SEQ ID NO: 1945 - DNA, 20 bp, Artificial Sequence
  Synthetic polynucleotide
gcttggctgtctaattattt

SEQ ID NO: 1946 - DNA, 20 bp, Artificial Sequence
  Synthetic polynucleotide
gggtggctcgtttcttattg

SEQ ID NO: 1947 - DNA, 20 bp, Artificial Sequence
  Synthetic polynucleotide
ggggtacggctttcgttctg

SEQ ID NO: 1948 - DNA, 20 bp, Artificial Sequence
  Synthetic polynucleotide
aaaggccgtcgtttattcta

SEQ ID NO: 1949 - DNA, 20 bp, Artificial Sequence
  Synthetic polynucleotide
gctttacatcctgtacttag

SEQ ID NO: 1950 - DNA, 20 bp, Artificial Sequence
  Synthetic polynucleotide
tggggccgttcttatccaat

SEQ ID NO: 1951 - DNA, 20 bp, Artificial Sequence
  Synthetic polynucleotide
tctggactcgcggaaaacta

SEQ ID NO: 1952 - DNA, 20 bp, Artificial Sequence
  Synthetic polynucleotide
tggatactcttgccgaaggg

SEQ ID NO: 1953 - DNA, 20 bp, Artificial Sequence
  Synthetic polynucleotide
attaccctacacagagtctc

SEQ ID NO: 1954 - DNA, 20 bp, Artificial Sequence
  Synthetic polynucleotide
aaggagcgagcatttagggt

SEQ ID NO: 1955 - DNA, 20 bp, Artificial Sequence
  Synthetic polynucleotide
gggactcacaaaaactggag

SEQ ID NO: 1956 - DNA, 20 bp, Artificial Sequence
  Synthetic polynucleotide
ttgcgacgaagagactgcgg

SEQ ID NO: 1957 - DNA, 20 bp, Artificial Sequence
  Synthetic polynucleotide
gaagagctgatatgcacaag

SEQ ID NO: 1958 - DNA, 20 bp, Artificial Sequence
  Synthetic polynucleotide
tacggccagagatagagggt

SEQ ID NO: 1959 - DNA, 20 bp, Artificial Sequence
  Synthetic polynucleotide
ggtacgcggggtgctaattt

SEQ ID NO: 1960 - DNA, 20 bp, Artificial Sequence
  Synthetic polynucleotide
aggcagctctccgaatttca

SEQ ID NO: 1961 - DNA, 20 bp, Artificial Sequence
  Synthetic polynucleotide
atggagccccccctttctct

SEQ ID NO: 1962 - DNA, 20 bp, Artificial Sequence
  Synthetic polynucleotide
gttggtctggtactcgccca

SEQ ID NO: 1963 - DNA, 20 bp, Artificial Sequence
  Synthetic polynucleotide
gtaggtcatcccgtgcattt

SEQ ID NO: 1964 - DNA, 20 bp, Artificial Sequence
  Synthetic polynucleotide
ctccccccatgcgagtatat

SEQ ID NO: 1965 - DNA, 20 bp, Artificial Sequence
  Synthetic polynucleotide
ggggtccgtccccatcacac

SEQ ID NO: 1966 - DNA, 20 bp, Artificial Sequence
  Synthetic polynucleotide
ggctatccgttccgtgcgaa

SEQ ID NO: 1967 - DNA, 20 bp, Artificial Sequence
  Synthetic polynucleotide
tcggggctcatgccagtaac

SEQ ID NO: 1968 - DNA, 20 bp, Artificial Sequence
  Synthetic polynucleotide
atgggtccggacattgatag

SEQ ID NO: 1969 - DNA, 20 bp, Artificial Sequence
  Synthetic polynucleotide
cgctagcatgaactacccag

SEQ ID NO: 1970 - DNA, 20 bp, Artificial Sequence
  Synthetic polynucleotide
gttcaaccccgatccgttgc

SEQ ID NO: 1971 - DNA, 20 bp, Artificial Sequence
  Synthetic polynucleotide
ggtacccctacacgcacggg

SEQ ID NO: 1972 - DNA, 20 bp, Artificial Sequence
  Synthetic polynucleotide
tacggacgactcttaaccag

SEQ ID NO: 1973 - DNA, 20 bp, Artificial Sequence
  Synthetic polynucleotide
tatccgcgagaatagacacc

SEQ ID NO: 1974 - DNA, 20 bp, Artificial Sequence
  Synthetic polynucleotide
tcgcggccaccaccagttct

SEQ ID NO: 1975 - DNA, 20 bp, Artificial Sequence
  Synthetic polynucleotide
gtcgctcggatcacgcgcct

SEQ ID NO: 1976 - DNA, 20 bp, Artificial Sequence
  Synthetic polynucleotide
cgggctctgactctgtattt

SEQ ID NO: 1977 - DNA, 20 bp, Artificial Sequence
  Synthetic polynucleotide
gctcgcccagctcgagtttg

SEQ ID NO: 1978 - DNA, 20 bp, Artificial Sequence
  Synthetic polynucleotide
ccttgtccgcggcgattatg

SEQ ID NO: 1979 - DNA, 20 bp, Artificial Sequence
  Synthetic polynucleotide
tcagcacggggtctttcttg

SEQ ID NO: 1980 - DNA, 20 bp, Artificial Sequence
  Synthetic polynucleotide
ggagggccgatctaaactat

SEQ ID NO: 1981 - DNA, 20 bp, Artificial Sequence
  Synthetic polynucleotide
gggcgtcgccggcgctcgag

SEQ ID NO: 1982 - DNA, 20 bp, Artificial Sequence
  Synthetic polynucleotide
cgggggccgcggactctgta

SEQ ID NO: 1983 - DNA, 20 bp, Artificial Sequence
  Synthetic polynucleotide
agaccccctccccaacggat

SEQ ID NO: 1984 - DNA, 20 bp, Artificial Sequence
  Synthetic polynucleotide
ggcccgccccattgaagcgg

SEQ ID NO: 1985 - DNA, 20 bp, Artificial Sequence
  Synthetic polynucleotide
tggctaccaccccgtcggac

SEQ ID NO: 1986 - DNA, 20 bp, Artificial Sequence
  Synthetic polynucleotide
gtagatccagccacccacgg

SEQ ID NO: 1987 - DNA, 20 bp, Artificial Sequence
  Synthetic polynucleotide
ggcacccccatcaatccagg

SEQ ID NO: 1988 - DNA, 20 bp, Artificial Sequence
  Synthetic polynucleotide
ggagagcaactaacaccagt

SEQ ID NO: 1989 - DNA, 20 bp, Artificial Sequence
  Synthetic polynucleotide
gctgatgtagtcactcttga

SEQ ID NO: 1990 - DNA, 20 bp, Artificial Sequence
  Synthetic polynucleotide
agatgcaggctgcagatgcc

SEQ ID NO: 1991 - DNA, 20 bp, Artificial Sequence
  Synthetic polynucleotide
ggccctcggcggcggctccc

SEQ ID NO: 1992 - DNA, 20 bp, Artificial Sequence
  Synthetic polynucleotide
acagaacatgttgttataga

SEQ ID NO: 1993 - DNA, 20 bp, Artificial Sequence
  Synthetic polynucleotide
acagattctggaaagctcct

SEQ ID NO: 1994 - DNA, 20 bp, Artificial Sequence
  Synthetic polynucleotide
ggtcaacaagtggaactcta

SEQ ID NO: 1995 - DNA, 20 bp, Artificial Sequence
  Synthetic polynucleotide
ggagtatttcaggggctctt

SEQ ID NO: 1996 - DNA, 20 bp, Artificial Sequence
  Synthetic polynucleotide
gggagggctgtgctgctagt

SEQ ID NO: 1997 - DNA, 20 bp, Artificial Sequence
  Synthetic polynucleotide
gcaacttgaaattatatctg

SEQ ID NO: 1998 - DNA, 20 bp, Artificial Sequence
  Synthetic polynucleotide
gtagagaaagaagcagtgcc

SEQ ID NO: 1999 - DNA, 20 bp, Artificial Sequence
  Synthetic polynucleotide
ataggagaagatgatgtata

SEQ ID NO: 2000 - DNA, 20 bp, Artificial Sequence
  Synthetic polynucleotide
gcatacagtgatttgatgaa

SEQ ID NO: 2001 - DNA, 20 bp, Artificial Sequence
  Synthetic polynucleotide
gggggccctcctcttgctgc

SEQ ID NO: 2002 - DNA, 20 bp, Artificial Sequence
  Synthetic polynucleotide
gaaaatcatcagttatcatc

SEQ ID NO: 2003 - DNA, 20 bp, Artificial Sequence
  Synthetic polynucleotide
ttcatgagtcttgacaacaa

SEQ ID NO: 2004 - DNA, 20 bp, Artificial Sequence
  Synthetic polynucleotide
ggtggcgggcactgtcgtca

SEQ ID NO: 2005 - DNA, 20 bp, Artificial Sequence
  Synthetic polynucleotide
atgacagtgccaaagccagc

SEQ ID NO: 2006 - DNA, 20 bp, Artificial Sequence
  Synthetic polynucleotide
acagtagaactaagggtggg

SEQ ID NO: 2007 - DNA, 20 bp, Artificial Sequence
  Synthetic polynucleotide
ccgccgtccaagacctaccg

SEQ ID NO: 2008 - DNA, 20 bp, Artificial Sequence
  Synthetic polynucleotide
gggctgtcaggtccttgggg

SEQ ID NO: 2009 - DNA, 20 bp, Artificial Sequence
  Synthetic polynucleotide
accatgagtaactccattcc

SEQ ID NO: 2010 - DNA, 20 bp, Artificial Sequence
  Synthetic polynucleotide
ggaggtagagattcatgtca

SEQ ID NO: 2011 - DNA, 20 bp, Artificial Sequence
  Synthetic polynucleotide
gaacgaatacagaaaagtaa

SEQ ID NO: 2012 - DNA, 20 bp, Artificial Sequence
  Synthetic polynucleotide
atccgtggcccatcatgtct

SEQ ID NO: 2013 - DNA, 20 bp, Artificial Sequence
  Synthetic polynucleotide
ggtggacaagcggcagatag

SEQ ID NO: 2014 - DNA, 20 bp, Artificial Sequence
  Synthetic polynucleotide
gaactgcaaagtgaaacaaa

SEQ ID NO: 2015 - DNA, 20 bp, Artificial Sequence
  Synthetic polynucleotide
actgacacgcagacattcag

SEQ ID NO: 2016 - DNA, 20 bp, Artificial Sequence
  Synthetic polynucleotide
cgaagctggaatctgctctc

SEQ ID NO: 2017 - DNA, 20 bp, Artificial Sequence
  Synthetic polynucleotide
gaccagccggggcagtgaag

SEQ ID NO: 2018 - DNA, 20 bp, Artificial Sequence
  Synthetic polynucleotide
gagtatctggtaccccagca

SEQ ID NO: 2019 - DNA, 20 bp, Artificial Sequence
  Synthetic polynucleotide
ctgggcaggcgacccgccgc

SEQ ID NO: 2020 - DNA, 20 bp, Artificial Sequence
  Synthetic polynucleotide
gttctccacggcacccccaa

SEQ ID NO: 2021 - DNA, 20 bp, Artificial Sequence
  Synthetic polynucleotide
gagaaagaataccatgcaga

SEQ ID NO: 2022 - DNA, 20 bp, Artificial Sequence
  Synthetic polynucleotide
ctcctcctctgctccgccac

SEQ ID NO: 2023 - DNA, 20 bp, Artificial Sequence
  Synthetic polynucleotide
gctcaggaggaggaagccgg

SEQ ID NO: 2024 - DNA, 20 bp, Artificial Sequence
  Synthetic polynucleotide
gctgaggaggggtcgcggcg

SEQ ID NO: 2025 - DNA, 20 bp, Artificial Sequence
  Synthetic polynucleotide
caagctgtttgccaaagagg

SEQ ID NO: 2026 - DNA, 20 bp, Artificial Sequence
  Synthetic polynucleotide
gcacgcagcggcgggagccc

SEQ ID NO: 2027 - DNA, 20 bp, Artificial Sequence
  Synthetic polynucleotide
ggcccccaagtggacagagc

SEQ ID NO: 2028 - DNA, 20 bp, Artificial Sequence
  Synthetic polynucleotide
ggaagggctaggcgggggcg

SEQ ID NO: 2029 - DNA, 20 bp, Artificial Sequence
  Synthetic polynucleotide
gcaaataaccttctgtgtca

SEQ ID NO: 2030 - DNA, 20 bp, Artificial Sequence
  Synthetic polynucleotide
gcaccaagtctgagtggacc

SEQ ID NO: 2031 - DNA, 20 bp, Artificial Sequence
  Synthetic polynucleotide
gcaggactcctttcctccat

SEQ ID NO: 2032 - DNA, 20 bp, Artificial Sequence
  Synthetic polynucleotide
gctgcgcctctgctgcgcct

SEQ ID NO: 2033 - DNA, 20 bp, Artificial Sequence
  Synthetic polynucleotide
gaagccagctgattataaga

SEQ ID NO: 2034 - DNA, 20 bp, Artificial Sequence
  Synthetic polynucleotide
ccaaaaaagaactgcacctc

SEQ ID NO: 2035 - DNA, 20 bp, Artificial Sequence
  Synthetic polynucleotide
gttcgactacgtggagaagc

SEQ ID NO: 2036 - DNA, 20 bp, Artificial Sequence
  Synthetic polynucleotide
cgaccaaagcgcctgaggac

SEQ ID NO: 2037 - DNA, 20 bp, Artificial Sequence
  Synthetic polynucleotide
cctggccacagcctacatcc

SEQ ID NO: 2038 - DNA, 20 bp, Artificial Sequence
  Synthetic polynucleotide
ggcactgacaatcccctttc

SEQ ID NO: 2039 - DNA, 20 bp, Artificial Sequence
  Synthetic polynucleotide
gaggagctccaagaagactg

SEQ ID NO: 2040 - DNA, 20 bp, Artificial Sequence
  Synthetic polynucleotide
gaagaagacaaatcacaaac

SEQ ID NO: 2041 - DNA, 20 bp, Artificial Sequence
  Synthetic polynucleotide
ggggcgggaagagcgcgtcc

SEQ ID NO: 2042 - DNA, 20 bp, Artificial Sequence
  Synthetic polynucleotide
ctcgtctgataagacaacag

SEQ ID NO: 2043 - DNA, 20 bp, Artificial Sequence
  Synthetic polynucleotide
gtgaatagagccagcaaagg

SEQ ID NO: 2044 - DNA, 20 bp, Artificial Sequence
  Synthetic polynucleotide
gactcgcagacgccctctgc

SEQ ID NO: 2045 - DNA, 20 bp, Artificial Sequence
  Synthetic polynucleotide
ttgtcgtcttctgtccaagt

SEQ ID NO: 2046 - DNA, 20 bp, Artificial Sequence
  Synthetic polynucleotide
gaggcgcagcagtgccacag

SEQ ID NO: 2047 - DNA, 20 bp, Artificial Sequence
  Synthetic polynucleotide
ggccatggcgggctggatcc

SEQ ID NO: 2048 - DNA, 20 bp, Artificial Sequence
  Synthetic polynucleotide
gagccaagatggggctctgc

SEQ ID NO: 2049 - DNA, 20 bp, Artificial Sequence
  Synthetic polynucleotide
gggtggggggagtttgctcc

SEQ ID NO: 2050 - DNA, 20 bp, Artificial Sequence
  Synthetic polynucleotide
gccgaggctgctggaggaag

SEQ ID NO: 2051 - DNA, 20 bp, Artificial Sequence
  Synthetic polynucleotide
gcaaaactcaaccctacccc

SEQ ID NO: 2052 - DNA, 20 bp, Artificial Sequence
  Synthetic polynucleotide
gaatccatcttcctgaccct

SEQ ID NO: 2053 - DNA, 20 bp, Artificial Sequence
  Synthetic polynucleotide
ctaggtgatgatgtcagatt

SEQ ID NO: 2054 - DNA, 20 bp, Artificial Sequence
  Synthetic polynucleotide
gagcagagatgtgggaatgg

SEQ ID NO: 2055 - DNA, 20 bp, Artificial Sequence
  Synthetic polynucleotide
gggactggggtcgggagggt

SEQ ID NO: 2056 - DNA, 20 bp, Artificial Sequence
  Synthetic polynucleotide
gagaaagctggagaaggggg

SEQ ID NO: 2057 - DNA, 20 bp, Artificial Sequence
  Synthetic polynucleotide
gcgcagggaagcgaccaact

SEQ ID NO: 2058 - DNA, 20 bp, Artificial Sequence
  Synthetic polynucleotide
gaagagggggagagagttac

SEQ ID NO: 2059 - DNA, 20 bp, Artificial Sequence
  Synthetic polynucleotide
gtggaagagtttgtggaagg

SEQ ID NO: 2060 - DNA, 20 bp, Artificial Sequence
  Synthetic polynucleotide
agttcccagctgcacgcctc

SEQ ID NO: 2061 - DNA, 20 bp, Artificial Sequence
  Synthetic polynucleotide
gaagagggaaacgtgtggct

SEQ ID NO: 2062 - DNA, 20 bp, Artificial Sequence
  Synthetic polynucleotide
ggtgggtctcgggactggca

SEQ ID NO: 2063 - DNA, 20 bp, Artificial Sequence
  Synthetic polynucleotide
gaatgagggtcctttgggaa

SEQ ID NO: 2064 - DNA, 20 bp, Artificial Sequence
  Synthetic polynucleotide
ggtgggggcggaagggggcc

SEQ ID NO: 2065 - DNA, 20 bp, Artificial Sequence
  Synthetic polynucleotide
cggccagagaccgagcccta

SEQ ID NO: 2066 - DNA, 20 bp, Artificial Sequence
  Synthetic polynucleotide
gttgtggcagcagtcactgg

SEQ ID NO: 2067 - DNA, 20 bp, Artificial Sequence
  Synthetic polynucleotide
caacagcagcagccacctgg

SEQ ID NO: 2068 - DNA, 20 bp, Artificial Sequence
  Synthetic polynucleotide
ggagccagcccctggccttc

SEQ ID NO: 2069 - DNA, 20 bp, Artificial Sequence
  Synthetic polynucleotide
tcccaaaggcggagggcgtt

SEQ ID NO: 2070 - DNA, 20 bp, Artificial Sequence
  Synthetic polynucleotide
tgagtccgagcagaagaaga

SEQ ID NO: 2071 - DNA, 20 bp, Artificial Sequence
  Synthetic polynucleotide
gagtccgagcagaagaagaa

SEQ ID NO: 2072 - DNA, 20 bp, Artificial Sequence
  Synthetic polynucleotide
ggcagccagcatgatgagac

SEQ ID NO: 2073 - DNA, 20 bp, Artificial Sequence
  Synthetic polynucleotide
cttctttgcttgttcaaatg

SEQ ID NO: 2074 - DNA, 20 bp, Artificial Sequence
  Synthetic polynucleotide
gcagggtgagtgtctcagcc

SEQ ID NO: 2075 - DNA, 20 bp, Artificial Sequence
  Synthetic polynucleotide
gaactgtgtgtgttgcaggg

SEQ ID NO: 2076 - DNA, 20 bp, Artificial Sequence
  Synthetic polynucleotide
gggctgagagagggacaagt

SEQ ID NO: 2077 - DNA, 20 bp, Artificial Sequence
  Synthetic polynucleotide
aaaacgtttccaagacatga

SEQ ID NO: 2078 - DNA, 20 bp, Artificial Sequence
  Synthetic polynucleotide
ccacgcccgcggggtgaagt

SEQ ID NO: 2079 - DNA, 20 bp, Artificial Sequence
  Synthetic polynucleotide
gcttgcagatggccatggcg

SEQ ID NO: 2080 - DNA, 20 bp, Artificial Sequence
  Synthetic polynucleotide
gaagcgcctggcagtgtacc

SEQ ID NO: 2081 - DNA, 20 bp, Artificial Sequence
  Synthetic polynucleotide
gtcatcttagtcattacctg

SEQ ID NO: 2082 - DNA, 20 bp, Artificial Sequence
  Synthetic polynucleotide
tgcccctccctccctggccc

SEQ ID NO: 2083 - DNA, 20 bp, Artificial Sequence
  Synthetic polynucleotide
agagccccccctcaaagaga

SEQ ID NO: 2084 - DNA, 20 bp, Artificial Sequence
  Synthetic polynucleotide
gagtccgagcagaagaagaa

SEQ ID NO: 2085 - DNA, 20 bp, Artificial Sequence
  Synthetic polynucleotide
ggaatcccttctgcagcacc

SEQ ID NO: 2086 - DNA, 20 bp, Artificial Sequence
  Synthetic polynucleotide
gaacacaaagcatagactgc

SEQ ID NO: 2087 - DNA, 20 bp, Artificial Sequence
  Synthetic polynucleotide
ggcccagactgagcacgtga

SEQ ID NO: 2088 - DNA, 20 bp, Artificial Sequence
  Synthetic polynucleotide
ggcactgcggctggaggtgg

SEQ ID NO: 2089 - DNA, 20 bp, Artificial Sequence
  Synthetic polynucleotide
agcagcagcagcagcagcag

SEQ ID NO: 2090 - DNA, 20 bp, Artificial Sequence
  Synthetic polynucleotide
atcagcagcagcagcagcag

SEQ ID NO: 2091 - DNA, 20 bp, Artificial Sequence
  Synthetic polynucleotide
agcagcagcagcagcagcag

SEQ ID NO: 2092 - DNA, 20 bp, Artificial Sequence
  Synthetic polynucleotide
agcagcagcagcagcagcag

SEQ ID NO: 2093 - DNA, 20 bp, Artificial Sequence
  Synthetic polynucleotide
gtccctcttgacagcagcag

SEQ ID NO: 2094 - DNA, 20 bp, Artificial Sequence
  Synthetic polynucleotide
cactggacatggaaatagag

SEQ ID NO: 2095 - DNA, 20 bp, Artificial Sequence
  Synthetic polynucleotide
gcaaatacgctatctgtagc

SEQ ID NO: 2096 - DNA, 20 bp, Artificial Sequence
  Synthetic polynucleotide
gcttttcttcaagctgccca

SEQ ID NO: 2097 - DNA, 20 bp, Artificial Sequence
  Synthetic polynucleotide
aaggaacgtgttttacccgg

SEQ ID NO: 2098 - DNA, 20 bp, Artificial Sequence
  Synthetic polynucleotide
cctgtgcgtcccccaggggc

SEQ ID NO: 2099 - DNA, 20 bp, Artificial Sequence
  Synthetic polynucleotide
cttaggcaagtaatgcaata

SEQ ID NO: 2100 - DNA, 20 bp, Artificial Sequence
  Synthetic polynucleotide
ggataacatcaaacacgtcc

SEQ ID NO: 2101 - DNA, 20 bp, Artificial Sequence
  Synthetic polynucleotide
tgcgactgcagaagatgacc

SEQ ID NO: 2102 - DNA, 20 bp, Artificial Sequence
  Synthetic polynucleotide
tgagtacgcataagcgacga

SEQ ID NO: 2103 - DNA, 20 bp, Artificial Sequence
  Synthetic polynucleotide
acaaggcgagcgtgggctgc

SEQ ID NO: 2104 - DNA, 20 bp, Artificial Sequence
  Synthetic polynucleotide
ctgtgagcgtgcccaggggc

SEQ ID NO: 2105 - DNA, 20 bp, Artificial Sequence
  Synthetic polynucleotide
gccagacactttgtgaagta

SEQ ID NO: 2106 - DNA, 20 bp, Artificial Sequence
  Synthetic polynucleotide
atatagacgcctctgctccc

SEQ ID NO: 2107 - DNA, 20 bp, Artificial Sequence
  Synthetic polynucleotide
acttttacagtattgaataa

SEQ ID NO: 2108 - DNA, 20 bp, Artificial Sequence
  Synthetic polynucleotide
acatacatccctctggacat

SEQ ID NO: 2109 - DNA, 20 bp, Artificial Sequence
  Synthetic polynucleotide
acatacatccctctggacat

SEQ ID NO: 2110 - DNA, 20 bp, Artificial Sequence
  Synthetic polynucleotide
ctgatacagttttcagggcc

SEQ ID NO: 2111 - DNA, 20 bp, Artificial Sequence
  Synthetic polynucleotide
tctttactgtttaagccaac

SEQ ID NO: 2112 - DNA, 20 bp, Artificial Sequence
  Synthetic polynucleotide
acttacagcttcttgtctcc

SEQ ID NO: 2113 - DNA, 20 bp, Artificial Sequence
  Synthetic polynucleotide
tgatggcagttaatgagctc

SEQ ID NO: 2114 - DNA, 20 bp, Artificial Sequence
  Synthetic polynucleotide
aaatgcttcctgtacacctg

SEQ ID NO: 2115 - DNA, 20 bp, Artificial Sequence
  Synthetic polynucleotide
gctgatcttcagcctccttt

SEQ ID NO: 2116 - DNA, 20 bp, Artificial Sequence
  Synthetic polynucleotide
gtggttcggcatcatagtgc

SEQ ID NO: 2117 - DNA, 55 bp, Artificial Sequence
  Synthetic polynucleotide
gtgctcttaactttcactttatagatttatagggttaataaatgggaatttatat

SEQ ID NO: 2118 - DNA, 55 bp, Artificial Sequence
  Synthetic polynucleotide
cctttgtaccaatcctctaaatagttaaataggaaggataacccaagatcaaaat

SEQ ID NO: 2119 - DNA, 55 bp, Artificial Sequence
  Synthetic polynucleotide
gtaaaagttaaaatatctttaacctaaaaccgggttcagcgacttatttagtcca

SEQ ID NO: 2120 - DNA, 55 bp, Artificial Sequence
  Synthetic polynucleotide
actgttaaattgtcatctttatgcttaaagaggcttaagttacttcaatctacta

SEQ ID NO: 2121 - DNA, 55 bp, Artificial Sequence
  Synthetic polynucleotide
gatattataatttaagcacagcaaggctcttggctagaattatacctagtacata

SEQ ID NO: 2122 - DNA, 55 bp, Artificial Sequence
  Synthetic polynucleotide
tcattctaattcttatcttgcaaggcttcaaggtcatatacgtatttattgtcac

SEQ ID NO: 2123 - DNA, 55 bp, Artificial Sequence
  Synthetic polynucleotide
catagaaacctccgctctacaatatgtatgtggaaataagaaattttacctacta

SEQ ID NO: 2124 - DNA, 55 bp, Artificial Sequence
  Synthetic polynucleotide
cttatatactacctcccatactggtacttctggataaaaaagaatatattggtat

SEQ ID NO: 2125 - DNA, 55 bp, Artificial Sequence
  Synthetic polynucleotide
cttacatactaacaatcctgcatacgaatacgggtttgttattaatcagataatg

SEQ ID NO: 2126 - DNA, 55 bp, Artificial Sequence
  Synthetic polynucleotide
aaaacaaaaaaccatccgttaatgtagcgtaggtttgacaactcatttatcaatt

SEQ ID NO: 2127 - DNA, 55 bp, Artificial Sequence
  Synthetic polynucleotide
atatattagattaatacatgtaagtctgtcaggcaagaagttagaatagtaccag

SEQ ID NO: 2128 - DNA, 55 bp, Artificial Sequence
  Synthetic polynucleotide
gttaaagcaaaaaagactacggttctgatctggttttttaataagccaacgattt

SEQ ID NO: 2129 - DNA, 55 bp, Artificial Sequence
  Synthetic polynucleotide
ttaaaccttttgtgctcgaagctagcaagcaggtataattatttatatatatgac

SEQ ID NO: 2130 - DNA, 55 bp, Artificial Sequence
  Synthetic polynucleotide
aaaatttataaactttcaatccttcaccacggggacgataagcagaaaattaata

SEQ ID NO: 2131 - DNA, 55 bp, Artificial Sequence
  Synthetic polynucleotide
tatttttaaaacatcaccaaatagatgcgatggtttcttgcaatcacctaaaata

SEQ ID NO: 2132 - DNA, 55 bp, Artificial Sequence
  Synthetic polynucleotide
ggttactcgcacatatcaccttggtaaaattggttaagggtaagatcgaaatcaa

SEQ ID NO: 2133 - DNA, 55 bp, Artificial Sequence
  Synthetic polynucleotide
aaagatcgactactctcaacatggtaaaattggtattttccaaatccctactagg

SEQ ID NO: 2134 - DNA, 55 bp, Artificial Sequence
  Synthetic polynucleotide
aaatctggtctctggcctccttcaggatttaggaaaatacgtttttttaaaattg

SEQ ID NO: 2135 - DNA, 55 bp, Artificial Sequence
  Synthetic polynucleotide
tgctacaataatagaactttattccttcctggggagtcaaccagatagttagtcg

SEQ ID NO: 2136 - DNA, 55 bp, Artificial Sequence
  Synthetic polynucleotide
ctgtaactctacattacttatattacttactggtttggaaggaaggtacagaagg

SEQ ID NO: 2137 - DNA, 55 bp, Artificial Sequence
  Synthetic polynucleotide
cgcgaaataatactgtccatagccttatagcggtaaggtcaaagttatatagtca

SEQ ID NO: 2138 - DNA, 55 bp, Artificial Sequence
  Synthetic polynucleotide
aggtgtaagaaggatgcacgaacttggatttggtaatagtatgtatcaatcgctt

SEQ ID NO: 2139 - DNA, 55 bp, Artificial Sequence
  Synthetic polynucleotide
caagctcataaaaatactcaacgtagatgtaggttcacttagcacctccacatct

SEQ ID NO: 2140 - DNA, 55 bp, Artificial Sequence
  Synthetic polynucleotide
agaacctcaagtacttctatcctaaattcctggatgatggaccaagtgatttcgt

SEQ ID NO: 2141 - DNA, 55 bp, Artificial Sequence
  Synthetic polynucleotide
atgaccaaaattcccacttaggaacgcattaggatgttgtgtattacacattaac

SEQ ID NO: 2142 - DNA, 55 bp, Artificial Sequence
  Synthetic polynucleotide
cgcgcttatatgatttcattatttgacagacgggaaaactcaaagattctcctag

SEQ ID NO: 2143 - DNA, 55 bp, Artificial Sequence
  Synthetic polynucleotide
taattacgatactgcaccagtatgacagtatggttaagcaatagtttcgaatccg

SEQ ID NO: 2144 - DNA, 55 bp, Artificial Sequence
  Synthetic polynucleotide
aaatgaacgataataactagaagcagacagtggtccttttaccacgttgaaactt

SEQ ID NO: 2145 - DNA, 55 bp, Artificial Sequence
  Synthetic polynucleotide
caaattatgatatattctcgtctaatacgtcggaaagagaaaggtgaacgttcct

SEQ ID NO: 2146 - DNA, 55 bp, Artificial Sequence
  Synthetic polynucleotide
taatcattcgacatagctttatgtccatgtcgggtaaggtaatagaaggggatac

SEQ ID NO: 2147 - DNA, 55 bp, Artificial Sequence
  Synthetic polynucleotide
cgaaaaaattacgatgcgcgaaggttattcaggttcttcatgtctcctccaccct

SEQ ID NO: 2148 - DNA, 55 bp, Artificial Sequence
  Synthetic polynucleotide
tttggtatacatttatcgctaacggatttctggattagttgccccacctctacac

SEQ ID NO: 2149 - DNA, 55 bp, Artificial Sequence
  Synthetic polynucleotide
gtgactgccaaaagcacaattcggataattcggttatcgtatagagaaatcggtc

SEQ ID NO: 2150 - DNA, 55 bp, Artificial Sequence
  Synthetic polynucleotide
taggaacaaaaccaggcaaagacactctctcggatagattgtatagtggtggtag

SEQ ID NO: 2151 - DNA, 55 bp, Artificial Sequence
  Synthetic polynucleotide
ctcgacagacaaaccacataaggaaatttgaggaacgtaactcacctcgataacc

SEQ ID NO: 2152 - DNA, 55 bp, Artificial Sequence
  Synthetic polynucleotide
cagcaatcctcacttcctagtggcaataattggcattgttgttgacatagatgct

SEQ ID NO: 2153 - DNA, 55 bp, Artificial Sequence
  Synthetic polynucleotide
tagcttagaccccagtcaaggtttattcaagggcggagaaataagctgtgctgaa

SEQ ID NO: 2154 - DNA, 55 bp, Artificial Sequence
  Synthetic polynucleotide
atgaacatcacaaacccgctgtctagctctaggtttttatgtcaatggggacagt

SEQ ID NO: 2155 - DNA, 55 bp, Artificial Sequence
  Synthetic polynucleotide
aaattgagctccctaacagtgctcttcgtgcggggagtttgtatacttggataca

SEQ ID NO: 2156 - DNA, 55 bp, Artificial Sequence
  Synthetic polynucleotide
tcggtcgcctttaacccctgagattggaattggaattctcgaatcaacctctgaa

SEQ ID NO: 2157 - DNA, 55 bp, Artificial Sequence
  Synthetic polynucleotide
gctcaaccttaaacatcgaataacgcgtagcggtgttagtactcccattttttga

SEQ ID NO: 2158 - DNA, 55 bp, Artificial Sequence
  Synthetic polynucleotide
cgtgatacaaatatcccaccgtggttcagatggttataagtatctccccacagca

SEQ ID NO: 2159 - DNA, 55 bp, Artificial Sequence
  Synthetic polynucleotide
ttaaaacatacctcaactatacatccgtgccggtaaattgtgtacgtgtgcgcct

SEQ ID NO: 2160 - DNA, 55 bp, Artificial Sequence
  Synthetic polynucleotide
gctggcgactcagattcaacacaagcctgccggttttatttgaaatgttaaaaac

SEQ ID NO: 2161 - DNA, 55 bp, Artificial Sequence
  Synthetic polynucleotide
gtagatatagttatatcatcagatcaccacgggctgcgtattaaggtgtagaagc

SEQ ID NO: 2162 - DNA, 55 bp, Artificial Sequence
  Synthetic polynucleotide
aggaaagttgcaccgtccgcgcggttaataaggttatataatcctgtgatgggtg

SEQ ID NO: 2163 - DNA, 55 bp, Artificial Sequence
  Synthetic polynucleotide
ggccgctttaactatgcatctggcctttaaagggccgataatcgaattgtctgcc

SEQ ID NO: 2164 - DNA, 55 bp, Artificial Sequence
  Synthetic polynucleotide
cactatactaccgacccctcagctatttcagggataaagttcgacatcgcgatac

SEQ ID NO: 2165 - DNA, 55 bp, Artificial Sequence
  Synthetic polynucleotide
tagccagctgtccccaccatccatggttatgggaaggaatagtaacgcgatacta

SEQ ID NO: 2166 - DNA, 55 bp, Artificial Sequence
  Synthetic polynucleotide
tcccattaccagtcttcgtctcagctagctggggattttggaatcgtctccgctt

SEQ ID NO: 2167 - DNA, 55 bp, Artificial Sequence
  Synthetic polynucleotide
cgcgaaattgacgtcgctttcagaatttcaggggtagtactggatgtgcaacact

SEQ ID NO: 2168 - DNA, 55 bp, Artificial Sequence
  Synthetic polynucleotide
cattagattgaatcttcccctgtttcctccaggggcaggaagagagcatgagagt

SEQ ID NO: 2169 - DNA, 55 bp, Artificial Sequence
  Synthetic polynucleotide
gccctcaccaactacgcccaaaccggctatgggctgacagtaattttttacaacc

SEQ ID NO: 2170 - DNA, 55 bp, Artificial Sequence
  Synthetic polynucleotide
ttttatgctcgataagcgattatggaatcatggacccacttccacgacccagcca

SEQ ID NO: 2171 - DNA, 55 bp, Artificial Sequence
  Synthetic polynucleotide
agcatacataaaacctctttcatacacgcacggggggagagattaagcgccgccc

SEQ ID NO: 2172 - DNA, 55 bp, Artificial Sequence
  Synthetic polynucleotide
gcggtgttggtgtccgcctactcaacacaacggagtattggtaaggttacgctgt

SEQ ID NO: 2173 - DNA, 55 bp, Artificial Sequence
  Synthetic polynucleotide
tgatgttatgagacatctgtgtacatacataggggctcggtcccctttcgcctcg

SEQ ID NO: 2174 - DNA, 55 bp, Artificial Sequence
  Synthetic polynucleotide
gtcccacgcaaaaagtcctcctttcaccacggggggagtgaatatgactagacgg

SEQ ID NO: 2175 - DNA, 55 bp, Artificial Sequence
  Synthetic polynucleotide
ttcaggatacccatcactcctaaagacgacgggtgttggcttcagtccatccgag

SEQ ID NO: 2176 - DNA, 55 bp, Artificial Sequence
  Synthetic polynucleotide
cacacattaaatcacccgaagtcctaccgaagggggcaatgcaaacgcagcgatt

SEQ ID NO: 2177 - DNA, 55 bp, Artificial Sequence
  Synthetic polynucleotide
agcaaccgccgaccagcccacacggaaattgggaatccgtgatgtgtcccccgtg

SEQ ID NO: 2178 - DNA, 55 bp, Artificial Sequence
  Synthetic polynucleotide
atcatcccccgaatccccctgattctcgctcggggggagcggcaaacgggagtta

SEQ ID NO: 2179 - DNA, 55 bp, Artificial Sequence
  Synthetic polynucleotide
tcccgaacgcgtagcactatctctgtctctggggggaaccagcgccgggcgcgcg

SEQ ID NO: 2180 - DNA, 55 bp, Artificial Sequence
  Synthetic polynucleotide
ggctagccgctcctatctccgaaccctgaacgggtgcgtagaagaggcaagcggt

SEQ ID NO: 2181 - DNA, 55 bp, Artificial Sequence
  Synthetic polynucleotide
gggcgcgagccctctgcagtaatttacttacggacgtggggccgggcggttggta

SEQ ID NO: 2182 - DNA, 55 bp, Artificial Sequence
  Synthetic polynucleotide
cccagaccgccttctaccttccagtcagtcgggtggctggctgggactggggggt

SEQ ID NO: 2183 - DNA, 55 bp, Artificial Sequence
  Synthetic polynucleotide
tcctctcgaatgccttcctcttccacacacggggtggacgcgtgggggaatgacc

SEQ ID NO: 2184 - DNA, 55 bp, Artificial Sequence
  Synthetic polynucleotide
acgtcattgcatccttctcaaaagacagacgggggagcggccggcgacggctgga

SEQ ID NO: 2185 - DNA, 55 bp, Artificial Sequence
  Synthetic polynucleotide
gccgggcgcgacgtccccactcgatgaagatggtagtaaaagctaccagctggcg

SEQ ID NO: 2186 - DNA, 55 bp, Artificial Sequence
  Synthetic polynucleotide
accaattcagttaagccacttaatcaccacggggagggtcgggggcggcgcctgc

SEQ ID NO: 2187 - DNA, 55 bp, Artificial Sequence
  Synthetic polynucleotide
gggctatctccacagtcgagcaattaccgagggcggactggggggttccggccgc

SEQ ID NO: 2188 - DNA, 55 bp, Artificial Sequence
  Synthetic polynucleotide
gaaccaacctcacactcccatcgatcccgatgggggggtgggtgtgcgaagttgc

SEQ ID NO: 2189 - DNA, 55 bp, Artificial Sequence
  Synthetic polynucleotide
acattgaaacaatactctgcgtgagtttagaggtattcgaaatacattactaagt

SEQ ID NO: 2190 - DNA, 55 bp, Artificial Sequence
  Synthetic polynucleotide
ttatacgtttacataacactccaatttaattgggtcgaatcagaagaggagaaat

SEQ ID NO: 2191 - DNA, 55 bp, Artificial Sequence
  Synthetic polynucleotide
attcattacatcaggtcactgctaataaataggttgtttatagatttcttctgga

SEQ ID NO: 2192 - DNA, 55 bp, Artificial Sequence
  Synthetic polynucleotide
tatcattatattcaaaccaaaagtaattaatgggcggcctgcatattacacattg

SEQ ID NO: 2193 - DNA, 55 bp, Artificial Sequence
  Synthetic polynucleotide
aaataccttaaaatttcagagaactactatgggaactctatagtttgttagttcc

SEQ ID NO: 2194 - DNA, 55 bp, Artificial Sequence
  Synthetic polynucleotide
gtaaaactacataaaactgcgcttggaatatggattttttaatccacaaatgtca

SEQ ID NO: 2195 - DNA, 55 bp, Artificial Sequence
  Synthetic polynucleotide
acgactcatctttcttctagaaggtcaaaagggaataaatatgtaataaagtgtt

SEQ ID NO: 2196 - DNA, 55 bp, Artificial Sequence
  Synthetic polynucleotide
tatatataaattaatacctttactaagaaggggcctcttcattccagatgattat

SEQ ID NO: 2197 - DNA, 55 bp, Artificial Sequence
  Synthetic polynucleotide
aatttttatcatatatcaaactagaaatgttggaaagtggggttccttaacgttc

SEQ ID NO: 2198 - DNA, 55 bp, Artificial Sequence
  Synthetic polynucleotide
taactacacttagattccctatattgcaattggttgtacataaatgtactcgaga

SEQ ID NO: 2199 - DNA, 55 bp, Artificial Sequence
  Synthetic polynucleotide
ctctaatctattaaatccaaccctatgatgaggagaagaataaaaatgcgtatac

SEQ ID NO: 2200 - DNA, 55 bp, Artificial Sequence
  Synthetic polynucleotide
tattattcagcctcgtctgaaattcgaaattggaacaagtagtatatatttcatg

SEQ ID NO: 2201 - DNA, 55 bp, Artificial Sequence
  Synthetic polynucleotide
tattaaacaaaattgtcactttaacccagccggtagttataaagtaatacggtaa

SEQ ID NO: 2202 - DNA, 55 bp, Artificial Sequence
  Synthetic polynucleotide
aaactgtcgtagtatccatatcaagaacgaaggttttttgtgtattatagaagaa

SEQ ID NO: 2203 - DNA, 55 bp, Artificial Sequence
  Synthetic polynucleotide
gttgttaatatacctccaggtattcacggttggaaaaaactataatcttacatat

SEQ ID NO: 2204 - DNA, 55 bp, Artificial Sequence
  Synthetic polynucleotide
aagcacccacttcaatcttagccctaattagggatagttaaacgagaattagtca

SEQ ID NO: 2205 - DNA, 55 bp, Artificial Sequence
  Synthetic polynucleotide
cttgtcagtgccacaaccaataatttatttaggtctgtgttgtgtttggctaact

SEQ ID NO: 2206 - DNA, 55 bp, Artificial Sequence
  Synthetic polynucleotide
tatggcaaccttataacgtttgcttatttatggatggatgaacaccggttgtcaa

SEQ ID NO: 2207 - DNA, 55 bp, Artificial Sequence
  Synthetic polynucleotide
gacatttatttagcaactggctttcaaacaagggtatcgagtagaagtgttctcg

SEQ ID NO: 2208 - DNA, 55 bp, Artificial Sequence
  Synthetic polynucleotide
ctatacgaattccgacccataggttatataaggtttaaacttgatccaaacccgg

SEQ ID NO: 2209 - DNA, 55 bp, Artificial Sequence
  Synthetic polynucleotide
taggtatacatccactcgatatggtagttttggtcttcaagttaaacacgactaa

SEQ ID NO: 2210 - DNA, 55 bp, Artificial Sequence
  Synthetic polynucleotide
gtcttccaaaaacaacctgtggcaggtatatggtcgttattcgttacactaattt

SEQ ID NO: 2211 - DNA, 55 bp, Artificial Sequence
  Synthetic polynucleotide
tctgtaaaaatcgacaccttaatataaccttggagcctcgctgggttctattgta

SEQ ID NO: 2212 - DNA, 55 bp, Artificial Sequence
  Synthetic polynucleotide
ggaaatttccaaaaggctattaagggtatccggtttttgatactcgatatattgg

SEQ ID NO: 2213 - DNA, 55 bp, Artificial Sequence
  Synthetic polynucleotide
cccatcaaattcacatcacatccaactaaccggtttgtatgtttgaggattactg

SEQ ID NO: 2214 - DNA, 55 bp, Artificial Sequence
  Synthetic polynucleotide
tcgaggatctctataacttatagtaccagttggtacagtttttgtttgcaaaagt

SEQ ID NO: 2215 - DNA, 55 bp, Artificial Sequence
  Synthetic polynucleotide
atacacgacgcaccaactcaatttgacgtttggattgtccatgttcgtaagttta

SEQ ID NO: 2216 - DNA, 55 bp, Artificial Sequence
  Synthetic polynucleotide
ttggaaaaggcgatctctgaataacacctgtggtaacagatttagttagtagcga

SEQ ID NO: 2217 - DNA, 55 bp, Artificial Sequence
  Synthetic polynucleotide
cacacaacttttacgcccctacgaacgagaagggactttttgttaatctaacatt

SEQ ID NO: 2218 - DNA, 55 bp, Artificial Sequence
  Synthetic polynucleotide
aatacaacccctgacacgacacttgatagatggaagcatatttatcagtattcat

SEQ ID NO: 2219 - DNA, 55 bp, Artificial Sequence
  Synthetic polynucleotide
gagccttgcctgtatacatcaactctttctggggagatgaggatgtttttgtagt

SEQ ID NO: 2220 - DNA, 55 bp, Artificial Sequence
  Synthetic polynucleotide
cagaccccttgccgtacactgttatttatttggatctaggaggtaacaacccatt

SEQ ID NO: 2221 - DNA, 55 bp, Artificial Sequence
  Synthetic polynucleotide
ccaactactcaaagagcacttccattaattagggggtgcgcactttcacttgact

SEQ ID NO: 2222 - DNA, 55 bp, Artificial Sequence
  Synthetic polynucleotide
cgtttagacttgtatacacataaattctttcggtgggtcgcagtgtggccagtga

SEQ ID NO: 2223 - DNA, 55 bp, Artificial Sequence
  Synthetic polynucleotide
ttttgtaccttctcaccaaatccatatatatggtacgagggaaacgagggacgga

SEQ ID NO: 2224 - DNA, 55 bp, Artificial Sequence
  Synthetic polynucleotide
cagaaactctcgtccacactcgggcaattgtggcttttaaagactaagttatcgg

SEQ ID NO: 2225 - DNA, 55 bp, Artificial Sequence
  Synthetic polynucleotide
cgaaaagtccgtccctctagcatcgggatatggttttgacaaatataaggagtct

SEQ ID NO: 2226 - DNA, 55 bp, Artificial Sequence
  Synthetic polynucleotide
acgactccaaaatatgcattatctacggctaggtctgttgtaggtggctagcaaa

SEQ ID NO: 2227 - DNA, 55 bp, Artificial Sequence
  Synthetic polynucleotide
acgatataaaccgactcgaatgggccaaattggtctaagaaggcacaacatgtga

SEQ ID NO: 2228 - DNA, 55 bp, Artificial Sequence
  Synthetic polynucleotide
tgacataatgatacttccaggtttatagcgaggttttaaagaaacgcccgccgtg

SEQ ID NO: 2229 - DNA, 55 bp, Artificial Sequence
  Synthetic polynucleotide
tttaactgagcaccacctatttctaacgctaggtataactaggtcgcccaagact

SEQ ID NO: 2230 - DNA, 55 bp, Artificial Sequence
  Synthetic polynucleotide
ctgagatgacccatcccttaacatatgaacaggttacgagaagagctagctcagt

SEQ ID NO: 2231 - DNA, 55 bp, Artificial Sequence
  Synthetic polynucleotide
ggatactctcagcatccatcaaacatgagatggtaagaggtagtttaccgcctat

SEQ ID NO: 2232 - DNA, 55 bp, Artificial Sequence
  Synthetic polynucleotide
tgggtttcacacgctacttaggcacctagaaggcttatgaaagtatgaaggaaaa

SEQ ID NO: 2233 - DNA, 55 bp, Artificial Sequence
  Synthetic polynucleotide
ctttgtagattatgcgcctgacataacgacgggtctcttttgttaggttaagctt

SEQ ID NO: 2234 - DNA, 55 bp, Artificial Sequence
  Synthetic polynucleotide
cgcaattattagtcaactgatttcctttccggggatggcgcaaaaggaactaggg

SEQ ID NO: 2235 - DNA, 55 bp, Artificial Sequence
  Synthetic polynucleotide
ttattcccttgctcctcttgggtctttaataggtcacgttaccgctccgaaaggg

SEQ ID NO: 2236 - DNA, 55 bp, Artificial Sequence
  Synthetic polynucleotide
tgtatcagcaaatcagcgcctgcattaattaggacgggggcggacggaagtcgtc

SEQ ID NO: 2237 - DNA, 55 bp, Artificial Sequence
  Synthetic polynucleotide
ctgggcgtcacaacaacacctattgtaaattgggccctgcggacggctcatgaag

SEQ ID NO: 2238 - DNA, 55 bp, Artificial Sequence
  Synthetic polynucleotide
tgctttccttgtaaagcttaaccatttacccggtcgaggttatggaatgcggggc

SEQ ID NO: 2239 - DNA, 55 bp, Artificial Sequence
  Synthetic polynucleotide
ggaaccgaccactcgtcatcttattgtttggggtacagagatcgccggacctaag

SEQ ID NO: 2240 - DNA, 55 bp, Artificial Sequence
  Synthetic polynucleotide
gaatacagccattccgccacacaatcaatctggaagggtaagtatccaccgaagc

SEQ ID NO: 2241 - DNA, 55 bp, Artificial Sequence
  Synthetic polynucleotide
ggtacattcgttcacaccgtcaactgttgctggagcttttaagtttccgatacgg

SEQ ID NO: 2242 - DNA, 55 bp, Artificial Sequence
  Synthetic polynucleotide
agttgagcagtgttgccctgataattctccggggaaattcgaatacgcagattcc

SEQ ID NO: 2243 - DNA, 55 bp, Artificial Sequence
  Synthetic polynucleotide
gacggacatgtacctgcatcccctgctagctggtaagacgaagtaagatttcaga

SEQ ID NO: 2244 - DNA, 55 bp, Artificial Sequence
  Synthetic polynucleotide
gacaacactcaatacccaaaattccgaaagtggcgagggatacatcagggtggta

SEQ ID NO: 2245 - DNA, 55 bp, Artificial Sequence
  Synthetic polynucleotide
actgaaaccccgtccccgtattacctgggctggaatctaacaatccctagcacac

SEQ ID NO: 2246 - DNA, 55 bp, Artificial Sequence
  Synthetic polynucleotide
ccgtgctctgtaacaacaagaagttatcgaagggagctcgcggcgggatcgcgaa

SEQ ID NO: 2247 - DNA, 55 bp, Artificial Sequence
  Synthetic polynucleotide
acaagtgactagatgccgtctaacccgaactggtttgtttaagtgcggtttgggg

SEQ ID NO: 2248 - DNA, 55 bp, Artificial Sequence
  Synthetic polynucleotide
actccgatcacttaagccgtataattacgtaggcccaggcagacaccgtatattg

SEQ ID NO: 2249 - DNA, 55 bp, Artificial Sequence
  Synthetic polynucleotide
acgacgccgcaccccactattagtctatcttggtgcggggaggagctccgccgat

SEQ ID NO: 2250 - DNA, 55 bp, Artificial Sequence
  Synthetic polynucleotide
gcacagaccccctccgcagcttagctatttagggacggggggtgactcccctccc

SEQ ID NO: 2251 - DNA, 55 bp, Artificial Sequence
  Synthetic polynucleotide
cgggcgccccaacccccacccgccttgtttgggattggtggagatgcttagggtt

SEQ ID NO: 2252 - DNA, 55 bp, Artificial Sequence
  Synthetic polynucleotide
gccgttccgacgcctacgacccctttatttaggggtgcatgcatgacgcagccgc

SEQ ID NO: 2253 - DNA, 55 bp, Artificial Sequence
  Synthetic polynucleotide
gggctccactacttcgccatgtcctcaatgtggacaggcggggcgcattgcggtg

SEQ ID NO: 2254 - DNA, 55 bp, Artificial Sequence
  Synthetic polynucleotide
gggggcgtcccgctatcccccagcgccacagggtgtttttggatcacgaatgacc

SEQ ID NO: 2255 - DNA, 55 bp, Artificial Sequence
  Synthetic polynucleotide
ctgccagatagtgcgccaagtacatcaatctggatgggggtgcggggcagtggcc

SEQ ID NO: 2256 - DNA, 55 bp, Artificial Sequence
  Synthetic polynucleotide
cttgagggcctcccttcatctctgtatgtacggcgaggggagcccgcgggcaggg

SEQ ID NO: 2257 - DNA, 55 bp, Artificial Sequence
  Synthetic polynucleotide
gccctctagctgcacgccccacctaaaaaaagggaggggtggctagcccctcgag

SEQ ID NO: 2258 - DNA, 55 bp, Artificial Sequence
  Synthetic polynucleotide
gcgagccaccatcgtccccagacacgcgattggctgcttggtttcggtcacccgg

SEQ ID NO: 2259 - DNA, 55 bp, Artificial Sequence
  Synthetic polynucleotide
gccctgtcactctctacccatgaactaaggaggaaccagcagctgccgctggcgc

SEQ ID NO: 2260 - DNA, 55 bp, Artificial Sequence
  Synthetic polynucleotide
tttgcctgctcctctcctaagccccccaagcgggaatagggagggtaacggggac

SEQ ID NO: 2261 - DNA, 55 bp, Artificial Sequence
  Synthetic polynucleotide
cggaggatccctcacacgagtatccccagtaggtgtgcggaatggagctacgggc

SEQ ID NO: 2262 - DNA, 55 bp, Artificial Sequence
  Synthetic polynucleotide
gcaagaccgaccgtctcctgcaatctcagcaggcgggaaaggagcggacacttgg

SEQ ID NO: 2263 - DNA, 55 bp, Artificial Sequence
  Synthetic polynucleotide
tgtgcccacgtacacacaattctacgaggtcggcgatgtagggcgcggagctggc

SEQ ID NO: 2264 - DNA, 55 bp, Artificial Sequence
  Synthetic polynucleotide
ttcgagagaaaattgcccattcattaattagggatacggatagtgattattttca

SEQ ID NO: 2265 - DNA, 55 bp, Artificial Sequence
  Synthetic polynucleotide
gagaaatataagtaaaccttcaactatttatggggtatgctattgttgtaaagac

SEQ ID NO: 2266 - DNA, 55 bp, Artificial Sequence
  Synthetic polynucleotide
gaaatctcacaaattacttcgaaaattattgggactagcagttcttctattattg

SEQ ID NO: 2267 - DNA, 55 bp, Artificial Sequence
  Synthetic polynucleotide
cagaaaaataaaacaactagtagtttgtttaggaagacgaaatactcccagaaga

SEQ ID NO: 2268 - DNA, 55 bp, Artificial Sequence
  Synthetic polynucleotide
atgagcgtcatactatcacaacattgattttggataagccgtaaatttaaaatcg

SEQ ID NO: 2269 - DNA, 55 bp, Artificial Sequence
  Synthetic polynucleotide
gaataagctttgagcactaagtatattgcacggtaaatgaagattcctaaatcta

SEQ ID NO: 2270 - DNA, 55 bp, Artificial Sequence
  Synthetic polynucleotide
ttagtattaaaaatagctagatgatggtcgaggatccacattccattatactctt

SEQ ID NO: 2271 - DNA, 55 bp, Artificial Sequence
  Synthetic polynucleotide
ctataaaacgttctaactcggaactaagaatggattatatgtagcttatacccaa

SEQ ID NO: 2272 - DNA, 55 bp, Artificial Sequence
  Synthetic polynucleotide
tgatattgggtaaattcaaaaaatgtttgctggctttcccagaattaaactagac

SEQ ID NO: 2273 - DNA, 55 bp, Artificial Sequence
  Synthetic polynucleotide
tacaatacaccaacatctcacttaaccctttggtgataaagcaattcgtaattat

SEQ ID NO: 2274 - DNA, 55 bp, Artificial Sequence
  Synthetic polynucleotide
aatcttaaattaatgtcctatagcgcacaagggaggcaatttcatgaatagttaa

SEQ ID NO: 2275 - DNA, 55 bp, Artificial Sequence
  Synthetic polynucleotide
attactagaataagaccatcttctctggtgcggaaatgtatgattttgaaatgat

SEQ ID NO: 2276 - DNA, 55 bp, Artificial Sequence
  Synthetic polynucleotide
aatcaagcataatacgcattaatgtagcgaaggtttttgataaacattttttgat

SEQ ID NO: 2277 - DNA, 55 bp, Artificial Sequence
  Synthetic polynucleotide
tgtaatatacagtaaactctttagcaacgctggtttatttgatagcactgctaat

SEQ ID NO: 2278 - DNA, 55 bp, Artificial Sequence
  Synthetic polynucleotide
tacagtaatatatatccctacatacaacagtgggcttaaggtaaaacgttcataa

SEQ ID NO: 2279 - DNA, 55 bp, Artificial Sequence
  Synthetic polynucleotide
tcgctcgtgacctccccatttaattattattggttgtctggaaacgttttgtaga

SEQ ID NO: 2280 - DNA, 55 bp, Artificial Sequence
  Synthetic polynucleotide
tagccatactgcttaacaagacttctttcatggattagggtgatttgccgtaatc

SEQ ID NO: 2281 - DNA, 55 bp, Artificial Sequence
  Synthetic polynucleotide
catctgttattgtccccaaaaaattaattacggggaacacttcagaccagtctga

SEQ ID NO: 2282 - DNA, 55 bp, Artificial Sequence
  Synthetic polynucleotide
aagggttacgcatccccccctgatgatttatggttctgtaaaaattggctataat

SEQ ID NO: 2283 - DNA, 55 bp, Artificial Sequence
  Synthetic polynucleotide
aaaagccttctacaatcgagtaataattatcgggttattatcaccacagctcggc

SEQ ID NO: 2284 - DNA, 55 bp, Artificial Sequence
  Synthetic polynucleotide
tttgactatgacccctcatatagatataagaggtatcttacagcgtgaaagagga

SEQ ID NO: 2285 - DNA, 55 bp, Artificial Sequence
  Synthetic polynucleotide
agaatcactagacaaaccacctgtcggtataggtatatagtaacgtacaacaacc

SEQ ID NO: 2286 - DNA, 55 bp, Artificial Sequence
  Synthetic polynucleotide
agagaacacatggataccgacatgcaattatggtatgtttaggtcacgtattttt

SEQ ID NO: 2287 - DNA, 55 bp, Artificial Sequence
  Synthetic polynucleotide
cgaacttcacaatgaccaatatagatctagtgggagaatttggaaaaagtaggga

SEQ ID NO: 2288 - DNA, 55 bp, Artificial Sequence
  Synthetic polynucleotide
tataaaccagaattgcccaaacttcacttctggttttggtatgtgttaatccctt

SEQ ID NO: 2289 - DNA, 55 bp, Artificial Sequence
  Synthetic polynucleotide
aattaccacttcctttcatcccaatagagagggattgatcgattctatttctaga

SEQ ID NO: 2290 - DNA, 55 bp, Artificial Sequence
  Synthetic polynucleotide
taagacctgtttgcacccatatcatacatcgggaaggagatcatttgaaatatga

SEQ ID NO: 2291 - DNA, 55 bp, Artificial Sequence
  Synthetic polynucleotide
aaaaagattgatttcacgatatatcaaggcgggctttcaaacactattgactacc

SEQ ID NO: 2292 - DNA, 55 bp, Artificial Sequence
  Synthetic polynucleotide
tctacatcgaatcgaacattaaattacggaaggttacctccagccatgttgagaa

SEQ ID NO: 2293 - DNA, 55 bp, Artificial Sequence
  Synthetic polynucleotide
ctccaccgttcacttactatacgaaccgaaagggtaattgtgaaagaagaaacaa

SEQ ID NO: 2294 - DNA, 55 bp, Artificial Sequence
  Synthetic polynucleotide
cttaaaaacagcccaactgctagattaaattgggcgattcgggcattacatgatc

SEQ ID NO: 2295 - DNA, 55 bp, Artificial Sequence
  Synthetic polynucleotide
tagcgctgctatgcttccttcctattattagggaaattagaggtgttagcggaag

SEQ ID NO: 2296 - DNA, 55 bp, Artificial Sequence
  Synthetic polynucleotide
gcgtcacatacctgtacataaaggatatttgggtttcgtaagcttcactctggcc

SEQ ID NO: 2297 - DNA, 55 bp, Artificial Sequence
  Synthetic polynucleotide
aaacccatggataaagctctgtcgttaatacggcgtacaatatagcccatcacga

SEQ ID NO: 2298 - DNA, 55 bp, Artificial Sequence
  Synthetic polynucleotide
aagaccaatccccgtacagccctaaataaaaggtggttttgcgtcatgatcatga

SEQ ID NO: 2299 - DNA, 55 bp, Artificial Sequence
  Synthetic polynucleotide
aactttctgtctctgtcatagtttgttaaaaggtttctacagaggaaagggccgg

SEQ ID NO: 2300 - DNA, 55 bp, Artificial Sequence
  Synthetic polynucleotide
aacctatatacccaccccacaagtgtaagtcggaggttgcttttatcatactaac

SEQ ID NO: 2301 - DNA, 55 bp, Artificial Sequence
  Synthetic polynucleotide
gatttccctcgcaaagcacgtaaggtccataggattttaacattcctccattagt

SEQ ID NO: 2302 - DNA, 55 bp, Artificial Sequence
  Synthetic polynucleotide
atgtgagctatcttcccgtatcttagaaccggggtgttgaacaaaaccgtacatg

SEQ ID NO: 2303 - DNA, 55 bp, Artificial Sequence
  Synthetic polynucleotide
ccctctgaaaaatctacacatttaagcgtgcggggagaagaagggcaacatttct

SEQ ID NO: 2304 - DNA, 55 bp, Artificial Sequence
  Synthetic polynucleotide
gtacttacctgcataccaaccctttaagtaaggcttcgggtgcatggtatctaca

SEQ ID NO: 2305 - DNA, 55 bp, Artificial Sequence
  Synthetic polynucleotide
ttaaattacctggtcacttcagtatatagcagggcaacattgcgcagggcgttat

SEQ ID NO: 2306 - DNA, 55 bp, Artificial Sequence
  Synthetic polynucleotide
gcaggaacgccatgatcaagtcaaccatgtaggtgacctatgcattaagtgtaaa

SEQ ID NO: 2307 - DNA, 55 bp, Artificial Sequence
  Synthetic polynucleotide
ccttcaccggtaagcacagaattccaggaatggttattttatgattgtgggggga

SEQ ID NO: 2308 - DNA, 55 bp, Artificial Sequence
  Synthetic polynucleotide
gtagataatccgtcacctcgatcgtcgagatggaaattaacatcgctactattca

SEQ ID NO: 2309 - DNA, 55 bp, Artificial Sequence
  Synthetic polynucleotide
gtgttgaactaccccccttagggggtttatcggcgaataatcagtactatcatgg

SEQ ID NO: 2310 - DNA, 55 bp, Artificial Sequence
  Synthetic polynucleotide
ctaataatagcatatacagcaagcatattgcggagggggaacgacatgccctagg

SEQ ID NO: 2311 - DNA, 55 bp, Artificial Sequence
  Synthetic polynucleotide
cgggaccctcgcctttcaccagatatttagaggtttagtacaacggagggacata

SEQ ID NO: 2312 - DNA, 55 bp, Artificial Sequence
  Synthetic polynucleotide
caactgctcctggcatcccgccttatagataggtagcggggtattgattgggacc

SEQ ID NO: 2313 - DNA, 55 bp, Artificial Sequence
  Synthetic polynucleotide
gagttccctgccccgcctacatacctaacttggaaggatgtatggccaatggtca

SEQ ID NO: 2314 - DNA, 55 bp, Artificial Sequence
  Synthetic polynucleotide
acctccgtgtaagatccctcaccttctcttgggagagtatagaactaccgtatca

SEQ ID NO: 2315 - DNA, 55 bp, Artificial Sequence
  Synthetic polynucleotide
cgaataacaaaaaacccggataccaaatcgggggctgtaaagtgtcgtggcgcat

SEQ ID NO: 2316 - DNA, 55 bp, Artificial Sequence
  Synthetic polynucleotide
ggttaacgacgcgtctccatattagtttaggggtgctagactcgcccttaaacga

SEQ ID NO: 2317 - DNA, 55 bp, Artificial Sequence
  Synthetic polynucleotide
tgagtattacattccacccccggacatctgaggtcatgctagtctgctagtgaga

SEQ ID NO: 2318 - DNA, 55 bp, Artificial Sequence
  Synthetic polynucleotide
aggatcaccagagctgccatcctagcagtagggttggcaacgtggattttaaaat

SEQ ID NO: 2319 - DNA, 55 bp, Artificial Sequence
  Synthetic polynucleotide
tgatgccggtgtaacaccataaatactatgagggatacagggtagagatcggctg

SEQ ID NO: 2320 - DNA, 55 bp, Artificial Sequence
  Synthetic polynucleotide
tatcaaggtaccaaaactcatccatacccttggtgacagggaggacggtgcaatt

SEQ ID NO: 2321 - DNA, 55 bp, Artificial Sequence
  Synthetic polynucleotide
agtttgcgtaaggtcaccataaatcatgggaggcatgtaccggagaggaagttcg

SEQ ID NO: 2322 - DNA, 55 bp, Artificial Sequence
  Synthetic polynucleotide
acgaatgaaagaatgccaaggtaaaaaggttggcccatttcgaattgtgcccccc

SEQ ID NO: 2323 - DNA, 55 bp, Artificial Sequence
  Synthetic polynucleotide
gagtccacgccgtagaccagtgacaccgtggggataatcgggattgtatagctca

SEQ ID NO: 2324 - DNA, 55 bp, Artificial Sequence
  Synthetic polynucleotide
caccgcacgctccactcgtcaaaaatttcaaggtggacggaacccggccgggggg

SEQ ID NO: 2325 - DNA, 55 bp, Artificial Sequence
  Synthetic polynucleotide
cgtcaaccgctcctctcggccggaatctttaggagtgagtgttgcgcacctcccc

SEQ ID NO: 2326 - DNA, 55 bp, Artificial Sequence
  Synthetic polynucleotide
accctacctcgctactctcccctcttaattagggggggggcgccacccatggagg

SEQ ID NO: 2327 - DNA, 55 bp, Artificial Sequence
  Synthetic polynucleotide
acggtctctctgatctctcctctcttcctagggacggcgctagacgggatggcgc

SEQ ID NO: 2328 - DNA, 55 bp, Artificial Sequence
  Synthetic polynucleotide
aggcattgaccaccgcccatccgtacttagtggagtacagatcgagccggccggg

SEQ ID NO: 2329 - DNA, 55 bp, Artificial Sequence
  Synthetic polynucleotide
ggagtctcctcccattccgcaactactgcggggaggctggggcgtgcgacgtgaa

SEQ ID NO: 2330 - DNA, 55 bp, Artificial Sequence
  Synthetic polynucleotide
aggggccccacacccgcacctacaaaggtttggacaagcgtgtgcggcgaatgga

SEQ ID NO: 2331 - DNA, 55 bp, Artificial Sequence
  Synthetic polynucleotide
tagccgtccaccgaccccgaagccctcgcatggatgcaaggggtggtaaacaccc

SEQ ID NO: 2332 - DNA, 55 bp, Artificial Sequence
  Synthetic polynucleotide
ccacccccctactccaccctctcggcctgagggataaatgtggttgcgcccggct

SEQ ID NO: 2333 - DNA, 55 bp, Artificial Sequence
  Synthetic polynucleotide
gttggccgtctttctccccccatgccatgatgggggactacgaaggccgcgacgt

SEQ ID NO: 2334 - DNA, 55 bp, Artificial Sequence
  Synthetic polynucleotide
ggactcccctatatgcctacgtaacaagcgggggtagctgggtggccgttggagc

SEQ ID NO: 2335 - DNA, 55 bp, Artificial Sequence
  Synthetic polynucleotide
tcccgctacccctacactattcacgtctggaggagtctgcacggaagggggggag

SEQ ID NO: 2336 - DNA, 55 bp, Artificial Sequence
  Synthetic polynucleotide
gaggctcacccagcatcgtatcacaaccgttggatggcgggcccagcgcatgctc

SEQ ID NO: 2337 - DNA, 55 bp, Artificial Sequence
  Synthetic polynucleotide
cccgaagatgaaccaacagacacctacgggcggcctcgtgtggagcggcgggtaa

SEQ ID NO: 2338 - DNA, 55 bp, Artificial Sequence
  Synthetic polynucleotide
ggccaattgcgcatctcactcgactaacggtggaagtgtaggggccgggcgatgg

SEQ ID NO: 2339 - DNA, 55 bp, Artificial Sequence
  Synthetic polynucleotide
tatggcttgattactcctgtgtgatttaaaaggaatttaaaccatttgcagagat

SEQ ID NO: 2340 - DNA, 55 bp, Artificial Sequence
  Synthetic polynucleotide
tcattaagttcaatatctgcctatttattgcggtacagtaaagttaatcagattt

SEQ ID NO: 2341 - DNA, 55 bp, Artificial Sequence
  Synthetic polynucleotide
gtgtaatttcaaacttcaaccaatataaatcggatgtctctgttattaacggata

SEQ ID NO: 2342 - DNA, 55 bp, Artificial Sequence
  Synthetic polynucleotide
tatgaaattgcaatatcctgtaatataatcgggaacgatgagtactggttcaata

SEQ ID NO: 2343 - DNA, 55 bp, Artificial Sequence
  Synthetic polynucleotide
taattgaaacaagcaacaaaatttgaatttagggtctatttatactgggaactga

SEQ ID NO: 2344 - DNA, 55 bp, Artificial Sequence
  Synthetic polynucleotide
atattgtcatacaattcacccctcgattcatggggttatatattgcatgaaaaat

SEQ ID NO: 2345 - DNA, 55 bp, Artificial Sequence
  Synthetic polynucleotide
aaatgccttaatcaaacgtcaagaatgtcttggacctttacgctattatatttct

SEQ ID NO: 2346 - DNA, 55 bp, Artificial Sequence
  Synthetic polynucleotide
ttcattataatttgcacaaaagttagtaaacggatatgaacgatctatatgacct

SEQ ID NO: 2347 - DNA, 55 bp, Artificial Sequence
  Synthetic polynucleotide
gttagaatcttctctaccattacattcatatggattgagaaagatgattaattca

SEQ ID NO: 2348 - DNA, 55 bp, Artificial Sequence
  Synthetic polynucleotide
aagattcgaataatagcttgggttgtaccacggaattaatctatatcattactaa

SEQ ID NO: 2349 - DNA, 55 bp, Artificial Sequence
  Synthetic polynucleotide
ggatcggcatcgtaatctcgtatttctgacaggatttaaaaataaatcttatttc

SEQ ID NO: 2350 - DNA, 55 bp, Artificial Sequence
  Synthetic polynucleotide
atgtatactctcagtacaaatgagagtatcaggtttaattattttactgcttgac

SEQ ID NO: 2351 - DNA, 55 bp, Artificial Sequence
  Synthetic polynucleotide
acttaattagtgaacacattaatatgacacggggctaggctatattttaaatctg

SEQ ID NO: 2352 - DNA, 55 bp, Artificial Sequence
  Synthetic polynucleotide
atacacctagatttcacaatctggcaacgatggtttaagaattttacacgttatt

SEQ ID NO: 2353 - DNA, 55 bp, Artificial Sequence
  Synthetic polynucleotide
ctatattaaacgattacattaatagacggccggtaatcttaggtgtttaatttag

SEQ ID NO: 2354 - DNA, 55 bp, Artificial Sequence
  Synthetic polynucleotide
atcagcatgccctctacaacagacttattgaggatagaattattattccgtaagg

SEQ ID NO: 2355 - DNA, 55 bp, Artificial Sequence
  Synthetic polynucleotide
gagtagaatgagcgccctatgggcataattcggtaagtacaaagaaatttaactc

SEQ ID NO: 2356 - DNA, 55 bp, Artificial Sequence
  Synthetic polynucleotide
gttatgcacacataatcatttctaatttaagggaacctcaaatgcgcacgcaaat

SEQ ID NO: 2357 - DNA, 55 bp, Artificial Sequence
  Synthetic polynucleotide
atactccatttcacgaccattcctgattagaggaattattcaggttcatggtcgt

SEQ ID NO: 2358 - DNA, 55 bp, Artificial Sequence
  Synthetic polynucleotide
gaagttactgatgtaactttggttgtttacgggagtagcaacatatacccttagt

SEQ ID NO: 2359 - DNA, 55 bp, Artificial Sequence
  Synthetic polynucleotide
gtactttcgcgggtctcgatcattattataaggttataaagggtctgctgatgta

SEQ ID NO: 2360 - DNA, 55 bp, Artificial Sequence
  Synthetic polynucleotide
tatgtaataatcctatcctccgatcgccttaggttaggaacttaaggttgcattg

SEQ ID NO: 2361 - DNA, 55 bp, Artificial Sequence
  Synthetic polynucleotide
tgtgtaaaatgttataccggttatacaatggggctctagtaaaaaatgagggtta

SEQ ID NO: 2362 - DNA, 55 bp, Artificial Sequence
  Synthetic polynucleotide
atacacgtttatattcccagtataattacagggagaagataccagcggacggtaa

SEQ ID NO: 2363 - DNA, 55 bp, Artificial Sequence
  Synthetic polynucleotide
ttaggaaaagccaattctaagagaaacctcgggggagtaatttgtatcttggtac

SEQ ID NO: 2364 - DNA, 55 bp, Artificial Sequence
  Synthetic polynucleotide
tcttcacatattcattccaacgtattaagggggtaagataaggaccttctcaatt

SEQ ID NO: 2365 - DNA, 55 bp, Artificial Sequence
  Synthetic polynucleotide
agattgcggttaagatcaaaattaatgacctgggcagttcacgtgcttcctttat

SEQ ID NO: 2366 - DNA, 55 bp, Artificial Sequence
  Synthetic polynucleotide
taagtcttcccaggtacttgtacaaccgtgcgggatatttataattaatcgtctg

SEQ ID NO: 2367 - DNA, 55 bp, Artificial Sequence
  Synthetic polynucleotide
agtcgagaaatagaaacttcctaaaaacgccgggtaagctttttcttgatcggta

SEQ ID NO: 2368 - DNA, 55 bp, Artificial Sequence
  Synthetic polynucleotide
atgactcctgtacactctctagaccattgatggaattaatggtagttgtagatgc

SEQ ID NO: 2369 - DNA, 55 bp, Artificial Sequence
  Synthetic polynucleotide
taactttgccagctccctactttctttaaaaggtctgaggctcgtaacttaggcc

SEQ ID NO: 2370 - DNA, 55 bp, Artificial Sequence
  Synthetic polynucleotide
agaaggtcagacgagcccctggctttaaataggtgttgtcgtcgatataattctt

SEQ ID NO: 2371 - DNA, 55 bp, Artificial Sequence
  Synthetic polynucleotide
catttccctttcttatctcacattcttgctgggggacaggacattccatctagaa

SEQ ID NO: 2372 - DNA, 55 bp, Artificial Sequence
  Synthetic polynucleotide
tgagaatcacaagctccatgcacgcttatgtgggaactataatttggggagaaag

SEQ ID NO: 2373 - DNA, 55 bp, Artificial Sequence
  Synthetic polynucleotide
aggcttgcgctctttacagttaattatatcagggccccgactgtacgactttgtt

SEQ ID NO: 2374 - DNA, 55 bp, Artificial Sequence
  Synthetic polynucleotide
cataaaattgttctgacaactcaagtttcgcgggcagctttagattacgtgaacg

SEQ ID NO: 2375 - DNA, 55 bp, Artificial Sequence
  Synthetic polynucleotide
gggtatgtttctataacgacattcatcataagggtcaagtagcgataggaggcgc

SEQ ID NO: 2376 - DNA, 55 bp, Artificial Sequence
  Synthetic polynucleotide
gacaacatcaacaacgccgtagtataggtttgggagctacttaatgaactggtgc

SEQ ID NO: 2377 - DNA, 55 bp, Artificial Sequence
  Synthetic polynucleotide
caagacaatagggtctcgggaaagaaattccggtcgccagcaatttttgcatttt

SEQ ID NO: 2378 - DNA, 55 bp, Artificial Sequence
  Synthetic polynucleotide
ttttatgcaatgatcccccacaatgttgggtggcgagatatagaagtctatccga

SEQ ID NO: 2379 - DNA, 55 bp, Artificial Sequence
  Synthetic polynucleotide
gtatacgccctttcgtctcgtttacccgaaaggaacaccgtatagcactctttat

SEQ ID NO: 2380 - DNA, 55 bp, Artificial Sequence
  Synthetic polynucleotide
tttcaacccaacggttctcacctattcacgaggttagatgatacgtatcactgcc

SEQ ID NO: 2381 - DNA, 55 bp, Artificial Sequence
  Synthetic polynucleotide
gttagtcctacccactcaaaattacgtagtagggagataccacattccagagtgg

SEQ ID NO: 2382 - DNA, 55 bp, Artificial Sequence
  Synthetic polynucleotide
tgcgtactggatactccctataacctctgaaggtcacgtgaaattctgagacaac

SEQ ID NO: 2383 - DNA, 55 bp, Artificial Sequence
  Synthetic polynucleotide
ggacctattacctttcccgaaacaaatggtgggacacacaagcatatttgttaag

SEQ ID NO: 2384 - DNA, 55 bp, Artificial Sequence
  Synthetic polynucleotide
taagctatactacgcccgccttagttattcgggattaagtatgagggccccacca

SEQ ID NO: 2385 - DNA, 55 bp, Artificial Sequence
  Synthetic polynucleotide
gcgacgtcccatctgacgattctaatttaaaggcacgagggcagttgctctgacg

SEQ ID NO: 2386 - DNA, 55 bp, Artificial Sequence
  Synthetic polynucleotide
gagctttttaccgctgctgccttgatttccagggtattaagttgtctccccccgg

SEQ ID NO: 2387 - DNA, 55 bp, Artificial Sequence
  Synthetic polynucleotide
caatcttctcgtcccccttccttaatttgtgggagtaattgcgcgtttatgcgag

SEQ ID NO: 2388 - DNA, 55 bp, Artificial Sequence
  Synthetic polynucleotide
gccaagctttcgcttacggggtaccctttaaggaagagcgtaagactgtgctatg

SEQ ID NO: 2389 - DNA, 55 bp, Artificial Sequence
  Synthetic polynucleotide
agtattacggtccccacggctcgccattataggatgcgatacgttagacttgtga

SEQ ID NO: 2390 - DNA, 55 bp, Artificial Sequence
  Synthetic polynucleotide
ggcggatctactaaccccagctgcgtatagaggagttgttataattccttgggct

SEQ ID NO: 2391 - DNA, 55 bp, Artificial Sequence
  Synthetic polynucleotide
tacgatgtagtacgaacacatagaacgtcctggcgtttttctcggtcctctcctg

SEQ ID NO: 2392 - DNA, 55 bp, Artificial Sequence
  Synthetic polynucleotide
agactacgactcacccccctctaacccctgtggatatttacacggtgctctcacc

SEQ ID NO: 2393 - DNA, 55 bp, Artificial Sequence
  Synthetic polynucleotide
taacctcagatgatcgcaggataaaaaccttggaatcatgcagtgccccaggccc

SEQ ID NO: 2394 - DNA, 55 bp, Artificial Sequence
  Synthetic polynucleotide
ggcaaagcacgcacatctaagtcgcatgtttggatgtccaagattttcctggtcc

SEQ ID NO: 2395 - DNA, 55 bp, Artificial Sequence
  Synthetic polynucleotide
agaggccttaatgttccgaaaaaaaccgtaaggtgcctatactggtgcccttgcc

SEQ ID NO: 2396 - DNA, 55 bp, Artificial Sequence
  Synthetic polynucleotide
tgccacttcaacaagtccgaatactacgtagggcaggtacccagctcatgcctct

SEQ ID NO: 2397 - DNA, 55 bp, Artificial Sequence
  Synthetic polynucleotide
gatttcatccactaaccaatacaagccaggtggttcgcgttagtgcggtaacaac

SEQ ID NO: 2398 - DNA, 55 bp, Artificial Sequence
  Synthetic polynucleotide
accggcactccacatacttctttgctcaggcggggaatggtggacgttggggacg

SEQ ID NO: 2399 - DNA, 55 bp, Artificial Sequence
  Synthetic polynucleotide
ctcccagcatactgggcgcccccccctttggggagttgtctgcggaatcaagtca

SEQ ID NO: 2400 - DNA, 55 bp, Artificial Sequence
  Synthetic polynucleotide
gcaatgccctagcgcaccccgcctacttctggggatgatcgatcacacgggagag

SEQ ID NO: 2401 - DNA, 55 bp, Artificial Sequence
  Synthetic polynucleotide
tggcacgtgaaccaaaccgcgacatatttcgggggctggttggggtgtgcggcct

SEQ ID NO: 2402 - DNA, 55 bp, Artificial Sequence
  Synthetic polynucleotide
atgggctcgcgctcacctcctgtgttaaatggggaagcgcggcccctcttcctga

SEQ ID NO: 2403 - DNA, 55 bp, Artificial Sequence
  Synthetic polynucleotide
aggcagaacccgcccccgactcacctaatttgggactataatgcggccgcgtccc

SEQ ID NO: 2404 - DNA, 55 bp, Artificial Sequence
  Synthetic polynucleotide
ccacatctcgtcccatctatcaactgattgggggggggcggacctcgtgggtggc

SEQ ID NO: 2405 - DNA, 55 bp, Artificial Sequence
  Synthetic polynucleotide
gatgtgacgcccgccccgcctgtttaatgaaggtctcgacagttcgcgcctacgg

SEQ ID NO: 2406 - DNA, 55 bp, Artificial Sequence
  Synthetic polynucleotide
gcaaccctgctcactccccatctacgttggtgggaggctgcaagcggtgtcaccg

SEQ ID NO: 2407 - DNA, 55 bp, Artificial Sequence
  Synthetic polynucleotide
gcaccccccgtcgcgcccgcaccacttgtttgggagtcggtaagggtgacaacgg

SEQ ID NO: 2408 - DNA, 55 bp, Artificial Sequence
  Synthetic polynucleotide
cacttgggtgcaccctcctagcttcctgagaggagtgggagcgtgcctcgagacc

SEQ ID NO: 2409 - DNA, 55 bp, Artificial Sequence
  Synthetic polynucleotide
gcagccgactacagatctcataatgtgggagggcccgttgcgccccttccgcgtt

SEQ ID NO: 2410 - DNA, 55 bp, Artificial Sequence
  Synthetic polynucleotide
tctggctatcgaccctcttactagtatgggtggggggtggcagggccgcagggta

SEQ ID NO: 2411 - DNA, 55 bp, Artificial Sequence
  Synthetic polynucleotide
tcccacaatcaaatcgcatccaattcctgcggggttacggaggcggggcgctccg

SEQ ID NO: 2412 - DNA, 55 bp, Artificial Sequence
  Synthetic polynucleotide
acgttcaaccgacatccactagcctccggggggaagcgtcaggcgatcagcgtga

SEQ ID NO: 2413 - DNA, 55 bp, Artificial Sequence
  Synthetic polynucleotide
agccgccgtcaccgttccttcatccacggcaggatgggaggtcgcccgattggcc

SEQ ID NO: 2414 - DNA, 55 bp, Artificial Sequence
  Synthetic polynucleotide
ctagaattttatatatcgtatatcatattttggatgttggacaaccggaaattcg

SEQ ID NO: 2415 - DNA, 55 bp, Artificial Sequence
  Synthetic polynucleotide
tatttaccatttcttgcttaacaaatttcatggcggacatcgtttaatgttactg

SEQ ID NO: 2416 - DNA, 55 bp, Artificial Sequence
  Synthetic polynucleotide
ctgtaaaaaccctattccacaacattataaaggtctgagcttttaatgttaatgg

SEQ ID NO: 2417 - DNA, 55 bp, Artificial Sequence
  Synthetic polynucleotide
ttagcatttcaatactcttacaataaattttggagccttttgactcgaatgctgt

SEQ ID NO: 2418 - DNA, 55 bp, Artificial Sequence
  Synthetic polynucleotide
atatcctctgtctaatcctttctcatataaagggtataccataattatacccttt

SEQ ID NO: 2419 - DNA, 55 bp, Artificial Sequence
  Synthetic polynucleotide
cggcagttaaagattacctcatttatataacggagatcctagagaaataaacata

SEQ ID NO: 2420 - DNA, 55 bp, Artificial Sequence
  Synthetic polynucleotide
acctctttatatttacctgataactcaaagaggaatagtttttttaatgttaatg

SEQ ID NO: 2421 - DNA, 55 bp, Artificial Sequence
  Synthetic polynucleotide
cattataatctgaatacctaacaaactagatggatttgacgtgaattaggaatcg

SEQ ID NO: 2422 - DNA, 55 bp, Artificial Sequence
  Synthetic polynucleotide
gccacccgcatacatacgaaaaacaagttttggatattatctagtaaaaaaagtt

SEQ ID NO: 2423 - DNA, 55 bp, Artificial Sequence
  Synthetic polynucleotide
ttaaattattagttgacccacataaccatggggttaatttaaagtaatagagagg

SEQ ID NO: 2424 - DNA, 55 bp, Artificial Sequence
  Synthetic polynucleotide
aaaataaagccataaccatagaaccattgtaggtgatgtgtgtgtttttataatt

SEQ ID NO: 2425 - DNA, 55 bp, Artificial Sequence
  Synthetic polynucleotide
aagaagagcatgtttgcaaaaaattattgtcggttcctcatgatatttaacataa

SEQ ID NO: 2426 - DNA, 55 bp, Artificial Sequence
  Synthetic polynucleotide
gttggaatcattatgacatacccttacggaaggaatttcttgattcatcattaat

SEQ ID NO: 2427 - DNA, 55 bp, Artificial Sequence
  Synthetic polynucleotide
taagaggaatgtattacataaccttaccgtaggaagtgtgtaattctagcaattt

SEQ ID NO: 2428 - DNA, 55 bp, Artificial Sequence
  Synthetic polynucleotide
gatctagtaaaaaacgcacaataaaacaggaggtagtgatagataagtatatagc

SEQ ID NO: 2429 - DNA, 55 bp, Artificial Sequence
  Synthetic polynucleotide
tggttattgcaccctccactaatcctatttcggagaattgtaacgtttaaggtct

SEQ ID NO: 2430 - DNA, 55 bp, Artificial Sequence
  Synthetic polynucleotide
actctaaactcatttccttaaacatatttgtggtagaagatgaggtttgccgata

SEQ ID NO: 2431 - DNA, 55 bp, Artificial Sequence
  Synthetic polynucleotide
tcttgatacagaatttcctttaatatattgaggcgcggtttgctgcattttgcgg

SEQ ID NO: 2432 - DNA, 55 bp, Artificial Sequence
  Synthetic polynucleotide
atcaactctagtccagccaccttctataaaaggatgaaacgttcatttgcaaagt

SEQ ID NO: 2433 - DNA, 55 bp, Artificial Sequence
  Synthetic polynucleotide
tctgatattattagagcgttaacgtaaaaggggtgcattcttctggagataggat

SEQ ID NO: 2434 - DNA, 55 bp, Artificial Sequence
  Synthetic polynucleotide
gttaggcaaatatactccaagccctcataatggatagatatgacaattcttcgat

SEQ ID NO: 2435 - DNA, 55 bp, Artificial Sequence
  Synthetic polynucleotide
tttttttccaccgttactcctcgctccgtaaggaatcttagattcagaaaactaa

SEQ ID NO: 2436 - DNA, 55 bp, Artificial Sequence
  Synthetic polynucleotide
aagttccattaaagtcctcatcatacaatgtggttctgcatcgagatgagtttgc

SEQ ID NO: 2437 - DNA, 55 bp, Artificial Sequence
  Synthetic polynucleotide
acacaaaattgtcgaccagaatccgctttggggtaacttttgatccaaaatgaag

SEQ ID NO: 2438 - DNA, 55 bp, Artificial Sequence
  Synthetic polynucleotide
tctaacgccagtagtcctaaattattcactagggaacggacacagtttacttata

SEQ ID NO: 2439 - DNA, 55 bp, Artificial Sequence
  Synthetic polynucleotide
aagacaatttgaactacaatatcaatatgggggaactctttgggtactgaacacg

SEQ ID NO: 2440 - DNA, 55 bp, Artificial Sequence
  Synthetic polynucleotide
tttataggttgattaacttcaccaaattggcgggtgaaagtgaacagcaattggc

SEQ ID NO: 2441 - DNA, 55 bp, Artificial Sequence
  Synthetic polynucleotide
tgtctaaagcatctaccccaagtacattggaggctgagtatctattcggtattaa

SEQ ID NO: 2442 - DNA, 55 bp, Artificial Sequence
  Synthetic polynucleotide
cataagagagcaaacaccaattccaccgtagggatgttgtataaaaagaggtcaa

SEQ ID NO: 2443 - DNA, 55 bp, Artificial Sequence
  Synthetic polynucleotide
cggaaatctgtacgtacagtgtagaaccaatgggcattttaaatatatcagattt

SEQ ID NO: 2444 - DNA, 55 bp, Artificial Sequence
  Synthetic polynucleotide
atcgtgaaactcgcttcgctctcgtaaattaggaaggtgccaatatactgaatcc

SEQ ID NO: 2445 - DNA, 55 bp, Artificial Sequence
  Synthetic polynucleotide
aaagaagtaaccatgcctgagcgctaaatttggtggtcttcgaccacagtttctg

SEQ ID NO: 2446 - DNA, 55 bp, Artificial Sequence
  Synthetic polynucleotide
acaagtttacgaaattctggatatcatttgcggtgctgcgtgaagttggtgagat

SEQ ID NO: 2447 - DNA, 55 bp, Artificial Sequence
  Synthetic polynucleotide
aggttgcagtagattgccgttgttgttaatcggaaagtcaccctctatgctaatg

SEQ ID NO: 2448 - DNA, 55 bp, Artificial Sequence
  Synthetic polynucleotide
cagtagtaatcagcaaccactttataaaaagggacgcatgtaggaggtagccttg

SEQ ID NO: 2449 - DNA, 55 bp, Artificial Sequence
  Synthetic polynucleotide
aaagcttttaacacggctaaaataacattggggggacctcctctgagccctttga

SEQ ID NO: 2450 - DNA, 55 bp, Artificial Sequence
  Synthetic polynucleotide
aaatgcaaagcgcgacctagactctattaacggtcataagttgggttgcgaacgt

SEQ ID NO: 2451 - DNA, 55 bp, Artificial Sequence
  Synthetic polynucleotide
ataggtacttacatggcatactttaatcctcggcgttggtttggttgagatggga

SEQ ID NO: 2452 - DNA, 55 bp, Artificial Sequence
  Synthetic polynucleotide
caggttgtctttacatcccttcatacttgagggggtcagatatgtgggctatcaa

SEQ ID NO: 2453 - DNA, 55 bp, Artificial Sequence
  Synthetic polynucleotide
tttggtcccaccctttccaacgagtacaaatggtgaatttattgcctatggcatc

SEQ ID NO: 2454 - DNA, 55 bp, Artificial Sequence
  Synthetic polynucleotide
tcgtataaagattggacacaaccaactggggggaataaagttatcgtgccgatcg

SEQ ID NO: 2455 - DNA, 55 bp, Artificial Sequence
  Synthetic polynucleotide
cccgactaagatatttcacttaatatccggggggctaacaaaatcaaccttcgcg

SEQ ID NO: 2456 - DNA, 55 bp, Artificial Sequence
  Synthetic polynucleotide
actaagtcaccctgtactatctttaacagaaggcggggagaatccatacgtgact

SEQ ID NO: 2457 - DNA, 55 bp, Artificial Sequence
  Synthetic polynucleotide
ttttcacggtcaatcccatctccaacgagaaggtgttataatcctaagcttccga

SEQ ID NO: 2458 - DNA, 55 bp, Artificial Sequence
  Synthetic polynucleotide
cgtcttgatatcaagacacacattcccagtggggttattttcggtttgacacttt

SEQ ID NO: 2459 - DNA, 55 bp, Artificial Sequence
  Synthetic polynucleotide
ccaaatgcccctttctcacgcaactaaattcggaggcgttggaaagcttgttgtg

SEQ ID NO: 2460 - DNA, 55 bp, Artificial Sequence
  Synthetic polynucleotide
ggttttgaccccctgactctgcatatttaagggtggcgtgcacaaggaaagctaa

SEQ ID NO: 2461 - DNA, 55 bp, Artificial Sequence
  Synthetic polynucleotide
tactacggtcgcgaaccccttagctctttgtggatgtgtcgagcgcgatgaaata

SEQ ID NO: 2462 - DNA, 55 bp, Artificial Sequence
  Synthetic polynucleotide
tgactcatccgaaatacagtatctattgctgggctgctcgctaacgacctaagag

SEQ ID NO: 2463 - DNA, 55 bp, Artificial Sequence
  Synthetic polynucleotide
ccgatacgctagactactgttgagatattcgggcggtaaccgccccatcccctct

SEQ ID NO: 2464 - DNA, 55 bp, Artificial Sequence
  Synthetic polynucleotide
ttcgggtagtcctcaccccctctgcaatttaggagttcagttattgtgagctcaa

SEQ ID NO: 2465 - DNA, 55 bp, Artificial Sequence
  Synthetic polynucleotide
gggtttcgcgcgtaggcataaaagtaactatggtcatttcgagcctctttcgcag

SEQ ID NO: 2466 - DNA, 55 bp, Artificial Sequence
  Synthetic polynucleotide
aacacgcccccgcgcccctcgtcaagattgtgggttacagttgatataggtttgc

SEQ ID NO: 2467 - DNA, 55 bp, Artificial Sequence
  Synthetic polynucleotide
ccgccacaaattgtcgcattgattattactaggcgctaggtgcgccctgtccctg

SEQ ID NO: 2468 - DNA, 55 bp, Artificial Sequence
  Synthetic polynucleotide
gctgggataatccacaccgataaatttggtgggctgctcagcgatgttagagatt

SEQ ID NO: 2469 - DNA, 55 bp, Artificial Sequence
  Synthetic polynucleotide
gtacccactcactagcccacacgtatatggggggtctagatgttcgtccaatcgc

SEQ ID NO: 2470 - DNA, 55 bp, Artificial Sequence
  Synthetic polynucleotide
ttggtgcacagtgcagcctctcttacaggtcggttgaatgaagtgggtcgatagt

SEQ ID NO: 2471 - DNA, 55 bp, Artificial Sequence
  Synthetic polynucleotide
tgcaattgtgttgctgcgtccaatcctagaaggtttagagagaactgcgggatgt

SEQ ID NO: 2472 - DNA, 55 bp, Artificial Sequence
  Synthetic polynucleotide
ggtcaaaaggctcccacgatctaacatggttggttccggggaggagtggacgccg

SEQ ID NO: 2473 - DNA, 55 bp, Artificial Sequence
  Synthetic polynucleotide
tctatagggcgtacaccacctaaacccgaaaggatagttgcatgttccatgtcag

SEQ ID NO: 2474 - DNA, 55 bp, Artificial Sequence
  Synthetic polynucleotide
cggccaggccctatcccgttcgctctttaagggaaggcggaggtcgtcccagaaa

SEQ ID NO: 2475 - DNA, 55 bp, Artificial Sequence
  Synthetic polynucleotide
tcgccgccgcatggcgctcttccctttaaagggatgtcacacaggaacgcctggc

SEQ ID NO: 2476 - DNA, 55 bp, Artificial Sequence
  Synthetic polynucleotide
gaaggcacgccctgccccccaactaattagggggcgcaggttcggcttggcgcgg

SEQ ID NO: 2477 - DNA, 55 bp, Artificial Sequence
  Synthetic polynucleotide
ttgctaggtagtttgtccaccctccaattgtggggggcaggggtttcggccgccc

SEQ ID NO: 2478 - DNA, 55 bp, Artificial Sequence
  Synthetic polynucleotide
ctcccctgcgcaagatcatcacttctatttggggcgccggggggtggatctgccg

SEQ ID NO: 2479 - DNA, 55 bp, Artificial Sequence
  Synthetic polynucleotide
ggcgagggtcccgtcccacacactcttattgggtaaaggcgcgtgagggtccacc

SEQ ID NO: 2480 - DNA, 55 bp, Artificial Sequence
  Synthetic polynucleotide
cacgtcgccgttagtacccatcgccctataaggggactgacgggaggggtgggtt

SEQ ID NO: 2481 - DNA, 55 bp, Artificial Sequence
  Synthetic polynucleotide
tagtacccctcgtgtccgcccatcttaagaggggggggcgtgtcaggaccagact

SEQ ID NO: 2482 - DNA, 55 bp, Artificial Sequence
  Synthetic polynucleotide
gcgtggtcgtgtcctcctgatacattcgttaggtacgggggaggcgggtgccagt

SEQ ID NO: 2483 - DNA, 55 bp, Artificial Sequence
  Synthetic polynucleotide
tcctgcgcgaatcgcgcctcctaactcgtggggggacgtaatcaggctctgggca

SEQ ID NO: 2484 - DNA, 55 bp, Artificial Sequence
  Synthetic polynucleotide
tccgacagcgcctcacccgcttacctaggttgggggagtgagatacgggacatcc

SEQ ID NO: 2485 - DNA, 55 bp, Artificial Sequence
  Synthetic polynucleotide
ttggcctcgccgcctccctcagtacccaagaggaaggagcgcagcaggcaatctc

SEQ ID NO: 2486 - DNA, 55 bp, Artificial Sequence
  Synthetic polynucleotide
ggaccacaatacactaccccaatcccagggaggtgtgtcggtgcgaaggcgaggg

SEQ ID NO: 2487 - DNA, 55 bp, Artificial Sequence
  Synthetic polynucleotide
ccgcagctatcactgacctcattcaaacgccggggtacgggtgcgtagcctggcg

SEQ ID NO: 2488 - DNA, 55 bp, Artificial Sequence
  Synthetic polynucleotide
taggagatgaaattatcccatctacaacgcgggcgggcggttccgggcggcgagg

SEQ ID NO: 2489 - DNA, 55 bp, Artificial Sequence
  Synthetic polynucleotide
atacataaattctgtactgctaaggtttaaaggttaatcatacatactagcaggt

SEQ ID NO: 2490 - DNA, 55 bp, Artificial Sequence
  Synthetic polynucleotide
ttcacaataatcaatcctctggtttaaaaatggtttgaccggaacgaattatagt

SEQ ID NO: 2491 - DNA, 55 bp, Artificial Sequence
  Synthetic polynucleotide
tttcatattgctaagtcatgttggtaaatacggtaaactacgttagaataaataa

SEQ ID NO: 2492 - DNA, 55 bp, Artificial Sequence
  Synthetic polynucleotide
cagcgtatactcactacatactggaaattatggaaagcaattataatcgttaatg

SEQ ID NO: 2493 - DNA, 55 bp, Artificial Sequence
  Synthetic polynucleotide
actaaactactcaacacgttataggtaattaggttaatgtgatatcacgaactaa

SEQ ID NO: 2494 - DNA, 55 bp, Artificial Sequence
  Synthetic polynucleotide
actttatttcttatagcaaatgcatctatctggctctactagtggtgaaatgtta

SEQ ID NO: 2495 - DNA, 55 bp, Artificial Sequence
  Synthetic polynucleotide
attgctcaagatgaatctctaaaaacaaacaggtgggcaattatatggttttagt

SEQ ID NO: 2496 - DNA, 55 bp, Artificial Sequence
  Synthetic polynucleotide
cgatttcttatacttacgtgttcggataatcggaactactaactgtaaatttaca

SEQ ID NO: 2497 - DNA, 55 bp, Artificial Sequence
  Synthetic polynucleotide
tatatacaagatattccgcaatggtacaaatggttatgaatcatatatgccgtat

SEQ ID NO: 2498 - DNA, 55 bp, Artificial Sequence
  Synthetic polynucleotide
aggatttatacatgtaccctggtattccactggtttttaagttttagtattgtct

SEQ ID NO: 2499 - DNA, 55 bp, Artificial Sequence
  Synthetic polynucleotide
ggagctatagggttaccacattaatacatacggatgaagtcaattgaaataataa

SEQ ID NO: 2500 - DNA, 55 bp, Artificial Sequence
  Synthetic polynucleotide
ttaataaaaacgtatccacaactcgtacctcggcattaagttataattgcattag

SEQ ID NO: 2501 - DNA, 55 bp, Artificial Sequence
  Synthetic polynucleotide
atgtttgtggtatatgcaaaattacagcagggggagtgttgttttaaaattaact

SEQ ID NO: 2502 - DNA, 55 bp, Artificial Sequence
  Synthetic polynucleotide
caaaggaatctataatcaagtatccgtcgttggataacctattatgataaataca

SEQ ID NO: 2503 - DNA, 55 bp, Artificial Sequence
  Synthetic polynucleotide
taatatattgcattcccaatatatcaccactggcgtcgtttataaaggaattaac

SEQ ID NO: 2504 - DNA, 55 bp, Artificial Sequence
  Synthetic polynucleotide
agttctaattggtaatcttcttccatttccaggcctattggaaacaagcatcttt

SEQ ID NO: 2505 - DNA, 55 bp, Artificial Sequence
  Synthetic polynucleotide
acctttataccgtaaacaatttgatatatttggcatcgttctccgtagcgtatga

SEQ ID NO: 2506 - DNA, 55 bp, Artificial Sequence
  Synthetic polynucleotide
aatagtttgtaccaatctgtgtggttaaaaaggttagacgttcccaaatgagtca

SEQ ID NO: 2507 - DNA, 55 bp, Artificial Sequence
  Synthetic polynucleotide
cccagatcgtaaaactcattgtgcgaattgtggagatttgtattaaccaataata

SEQ ID NO: 2508 - DNA, 55 bp, Artificial Sequence
  Synthetic polynucleotide
gcataaataaaattgccccgagaggtttagaggatcttcacttaacccacaacta

SEQ ID NO: 2509 - DNA, 55 bp, Artificial Sequence
  Synthetic polynucleotide
aagttatacttctttccaggtcccgtttgcaggtaccgagagctcttattaatat

SEQ ID NO: 2510 - DNA, 55 bp, Artificial Sequence
  Synthetic polynucleotide
ataattacgataaaaacaactggataagtctggaagcttttcacccggctcaaag

SEQ ID NO: 2511 - DNA, 55 bp, Artificial Sequence
  Synthetic polynucleotide
atcgggatttgatcatcactcaagggctataggcctttttactgcgtcaatatat

SEQ ID NO: 2512 - DNA, 55 bp, Artificial Sequence
  Synthetic polynucleotide
caaggagtactattatcttcacatggcatgtggcaaatatagtgtaacctcacag

SEQ ID NO: 2513 - DNA, 55 bp, Artificial Sequence
  Synthetic polynucleotide
tgttccgactaagtttcacaaaggttccaaaggaaattaaaccgcagtgtcaaga

SEQ ID NO: 2514 - DNA, 55 bp, Artificial Sequence
  Synthetic polynucleotide
aagtcaacattaatatctagatcccggttccggcacttgacataaatgagacctt

SEQ ID NO: 2515 - DNA, 55 bp, Artificial Sequence
  Synthetic polynucleotide
ttaacttcaggtccctcgcccaggaagtgaaggtcataataattaaatccgttta

SEQ ID NO: 2516 - DNA, 55 bp, Artificial Sequence
  Synthetic polynucleotide
agcatataaagtctctcacaatacgaacgaagggcgagttgtgtttatacgtaac

SEQ ID NO: 2517 - DNA, 55 bp, Artificial Sequence
  Synthetic polynucleotide
cctatattgattcatacagagacagtcgtccggattgaatttcaaaaccgggatt

SEQ ID NO: 2518 - DNA, 55 bp, Artificial Sequence
  Synthetic polynucleotide
cttttcggttaattgacttacacagacaacaggctataaatagagtctgatactc

SEQ ID NO: 2519 - DNA, 55 bp, Artificial Sequence
  Synthetic polynucleotide
ggaagagttttgaattcctaaatcctttcctggaggaagcgctagtagtcttggc

SEQ ID NO: 2520 - DNA, 55 bp, Artificial Sequence
  Synthetic polynucleotide
tttggatggactatcaccgttggcataaattggcaaagcctatcattccctacaa

SEQ ID NO: 2521 - DNA, 55 bp, Artificial Sequence
  Synthetic polynucleotide
aggcgaatgcagaatccccttggctttatatggcttagggtaataagagctcaat

SEQ ID NO: 2522 - DNA, 55 bp, Artificial Sequence
  Synthetic polynucleotide
tgagatttgtgagagccgggtctggcaatctggttataaccaaccaaattcagac

SEQ ID NO: 2523 - DNA, 55 bp, Artificial Sequence
  Synthetic polynucleotide
gaacgcactcatatagctgtggtcttacttaggaatggacttaagaagcgaggac

SEQ ID NO: 2524 - DNA, 55 bp, Artificial Sequence
  Synthetic polynucleotide
ttagtcactctgaatacgtttactatgtatggggacgctatccgccgctgaacat

SEQ ID NO: 2525 - DNA, 55 bp, Artificial Sequence
  Synthetic polynucleotide
ggtgtatgctaagtggccttcatctgtatctggacatagtaatttaagagagcac

SEQ ID NO: 2526 - DNA, 55 bp, Artificial Sequence
  Synthetic polynucleotide
ttgaactagactgcctccgtcatatcaatcaggaagtctactttcgcgacaatat

SEQ ID NO: 2527 - DNA, 55 bp, Artificial Sequence
  Synthetic polynucleotide
atgtacttacagtagacctgattagcaattaggcttctctatggtcgctcccacc

SEQ ID NO: 2528 - DNA, 55 bp, Artificial Sequence
  Synthetic polynucleotide
tcgaacattaaagtgactaaacagagcgagcggtctcaactgtcttatgatgtag

SEQ ID NO: 2529 - DNA, 55 bp, Artificial Sequence
  Synthetic polynucleotide
attcgttcttaactagcgctatttggaaggtggaacccatacacctttcgcgtga

SEQ ID NO: 2530 - DNA, 55 bp, Artificial Sequence
  Synthetic polynucleotide
ttcgaaattttatcaccctggcatagacataggtcattcgacgtctcatgcccgt

SEQ ID NO: 2531 - DNA, 55 bp, Artificial Sequence
  Synthetic polynucleotide
ttccgcgtaatagtaactcaacctcagcagtggaaaacggattttctgagactta

SEQ ID NO: 2532 - DNA, 55 bp, Artificial Sequence
  Synthetic polynucleotide
ttcttcacctacgtaactgacgagaaccgagggcaaatgtattgtttctgttagc

SEQ ID NO: 2533 - DNA, 55 bp, Artificial Sequence
  Synthetic polynucleotide
cacctttccagtttgactttaaacagcagctggggattagaagatcctaaaaacg

SEQ ID NO: 2534 - DNA, 55 bp, Artificial Sequence
  Synthetic polynucleotide
cgtggcaaatgatcatcttggacctaaatttggacaattcgtgtcacggggactc

SEQ ID NO: 2535 - DNA, 55 bp, Artificial Sequence
  Synthetic polynucleotide
tatgcatcgccctttgctcagacgtttctcaggtaaagcaaggtcccccaatagc

SEQ ID NO: 2536 - DNA, 55 bp, Artificial Sequence
  Synthetic polynucleotide
tgatgccgacaactttcttaggcgatttaaaggcgtgatgtccagcgcaagtcta

SEQ ID NO: 2537 - DNA, 55 bp, Artificial Sequence
  Synthetic polynucleotide
cccttagcccccgcatcgatcactgaaactgggagcagaaaggtacgtgtcgatc

SEQ ID NO: 2538 - DNA, 55 bp, Artificial Sequence
  Synthetic polynucleotide
tgtcgcctcctgaaaccctatgcaaatatgcggttgaaggtagctcatgtatagg

SEQ ID NO: 2539 - DNA, 55 bp, Artificial Sequence
  Synthetic polynucleotide
ggagtcgaagtgaggtcttacggcacatttaggcattttgggaggttcccttcct

SEQ ID NO: 2540 - DNA, 55 bp, Artificial Sequence
  Synthetic polynucleotide
cgcgagacaaggtccacaatcggtcttgatcggcgatatttagggcattgccctg

SEQ ID NO: 2541 - DNA, 55 bp, Artificial Sequence
  Synthetic polynucleotide
acttatcccgccaacacgcaagcatggttatggaaatagctcgttatacgggtgt

SEQ ID NO: 2542 - DNA, 55 bp, Artificial Sequence
  Synthetic polynucleotide
attctccctaagagttcggttgaggcaatacggcaaaagccttcccttgtcgatg

SEQ ID NO: 2543 - DNA, 55 bp, Artificial Sequence
  Synthetic polynucleotide
aaggacaaagtgaccccccacatatcggatcggcgaattttgtcgggtatggagt

SEQ ID NO: 2544 - DNA, 55 bp, Artificial Sequence
  Synthetic polynucleotide
gtcctctttgtcacaacctggatcaaggattggatctaggttaacctctgctctc

SEQ ID NO: 2545 - DNA, 55 bp, Artificial Sequence
  Synthetic polynucleotide
attacggcctcccataccctgttgacctgatggttgactagtggacagcgggtgt

SEQ ID NO: 2546 - DNA, 55 bp, Artificial Sequence
  Synthetic polynucleotide
cattgagctacatcatcatatagtgacgactgggccgagcgagggggcctcacaa

SEQ ID NO: 2547 - DNA, 55 bp, Artificial Sequence
  Synthetic polynucleotide
atatgcgagccttacacccccaatccgagatggaaatccgatagttcgtgtccac

SEQ ID NO: 2548 - DNA, 55 bp, Artificial Sequence
  Synthetic polynucleotide
gccaagataatcagcaccgataccgcgaagcggtaaatttgtttgactgtgccta

SEQ ID NO: 2549 - DNA, 55 bp, Artificial Sequence
  Synthetic polynucleotide
ggtgccactgagatgtcgacgaggctttcaaggccccccagaacctgcaggccga

SEQ ID NO: 2550 - DNA, 55 bp, Artificial Sequence
  Synthetic polynucleotide
tccacctgcttctagactcgaggaatttcgaggccccaggcctctccgccgggtg

SEQ ID NO: 2551 - DNA, 55 bp, Artificial Sequence
  Synthetic polynucleotide
gccacggggatccctcccctctgggcatttaggcattgtacacgtcctcacagcg

SEQ ID NO: 2552 - DNA, 55 bp, Artificial Sequence
  Synthetic polynucleotide
cccccggggtcgctccctgccggtaattacaggtaacttgactgacgagcgtagc

SEQ ID NO: 2553 - DNA, 55 bp, Artificial Sequence
  Synthetic polynucleotide
cgcttgccgacgcacgccctttctgcatctggggggtagaggtatcagtaccctg

SEQ ID NO: 2554 - DNA, 55 bp, Artificial Sequence
  Synthetic polynucleotide
cttcgccgttgctcatccccactctgctctgggaagggtgtcgacggggcaagtc

SEQ ID NO: 2555 - DNA, 55 bp, Artificial Sequence
  Synthetic polynucleotide
acatccctcccattgtcccccaccagctagcggataggggggctatgcctgctac

SEQ ID NO: 2556 - DNA, 55 bp, Artificial Sequence
  Synthetic polynucleotide
gcaccgcatccctctcctagagccatgtcatggttcttggtgcggaactcgggcc

SEQ ID NO: 2557 - DNA, 55 bp, Artificial Sequence
  Synthetic polynucleotide
cggggcaagatttaagctcgggaaaagtctcggccacgtcacgtcatggccgggc

SEQ ID NO: 2558 - DNA, 55 bp, Artificial Sequence
  Synthetic polynucleotide
aacctcttaggtacaccattagtgagtgagtgggcgcccctcaggcctcccccgc

SEQ ID NO: 2559 - DNA, 55 bp, Artificial Sequence
  Synthetic polynucleotide
cctcatgagcctttgtcatcgttccgacgaaggggactaggcatgccagggggcc

SEQ ID NO: 2560 - DNA, 55 bp, Artificial Sequence
  Synthetic polynucleotide
gagtgcacggtccggacaggaagaggcataaggctcctaccatccttaccgcccc

SEQ ID NO: 2561 - DNA, 55 bp, Artificial Sequence
  Synthetic polynucleotide
tcgcccagcacctagtccctaaatcaccacgggtgcgctgcggacgactagccca

SEQ ID NO: 2562 - DNA, 55 bp, Artificial Sequence
  Synthetic polynucleotide
tgccgctacgaccagtcgacaatgaaccaatggggcatgccccgggcatcgtgcg

SEQ ID NO: 2563 - DNA, 55 bp, Artificial Sequence
  Synthetic polynucleotide
ccggcttgattcactcctacgctaaaacgctggtacagttgggcgggccgtcgcc

SEQ ID NO: 2564 - DNA, 55 bp, Artificial Sequence
  Synthetic polynucleotide
aatcaaagattatactcccttaccttattacgggcaacgatgttattataattag

SEQ ID NO: 2565 - DNA, 55 bp, Artificial Sequence
  Synthetic polynucleotide
caacaatgattctaatctttaggtatttctaggattacaaagatctgccaaagta

SEQ ID NO: 2566 - DNA, 55 bp, Artificial Sequence
  Synthetic polynucleotide
ataatgctagaaacgacttgtacattaattaggtataacaagatcagaaagttta

SEQ ID NO: 2567 - DNA, 55 bp, Artificial Sequence
  Synthetic polynucleotide
ctttagttgtcaagaacatagcagctttcttggaatgtttatcaaaagtgatttt

SEQ ID NO: 2568 - DNA, 55 bp, Artificial Sequence
  Synthetic polynucleotide
cactcgaaataatctccaagattgtctttctggcaaattttaccataatttaaac

SEQ ID NO: 2569 - DNA, 55 bp, Artificial Sequence
  Synthetic polynucleotide
ttttttaagctcgtacctctaattgattattggtcataggtggtaactaatatct

SEQ ID NO: 2570 - DNA, 55 bp, Artificial Sequence
  Synthetic polynucleotide
gacaatttctgaaaatcactactgaaattctggtattacgccttctaataacaaa

SEQ ID NO: 2571 - DNA, 55 bp, Artificial Sequence
  Synthetic polynucleotide
cttatctacgatatctcaattagactatagagggttttattagaaggaatgactg

SEQ ID NO: 2572 - DNA, 55 bp, Artificial Sequence
  Synthetic polynucleotide
aaataagatgactttaccatcgtgtataaaaggtataactgttaaatttaaattg

SEQ ID NO: 2573 - DNA, 55 bp, Artificial Sequence
  Synthetic polynucleotide
ttacttcaccagatatcatgtgactaactatggttttttatagatcgtaagacct

SEQ ID NO: 2574 - DNA, 55 bp, Artificial Sequence
  Synthetic polynucleotide
atcgggggctgtatatcattcgatcaagattggtcaaaattttaatagagtttaa

SEQ ID NO: 2575 - DNA, 55 bp, Artificial Sequence
  Synthetic polynucleotide
agaatctttaaaatcacctccttatacccttggaatcattgtatgttgaaacatc

SEQ ID NO: 2576 - DNA, 55 bp, Artificial Sequence
  Synthetic polynucleotide
actagagatgatagtactagcacagaccagtgggtaaatttcatatattatatta

SEQ ID NO: 2577 - DNA, 55 bp, Artificial Sequence
  Synthetic polynucleotide
aacatattaactatgacaccgaaatacgaaaggtatatcgtagtttacgtttttg

SEQ ID NO: 2578 - DNA, 55 bp, Artificial Sequence
  Synthetic polynucleotide
aattaacaaaatttgacaaggcaacatcataggaattctgtgcgttactaaacag

SEQ ID NO: 2579 - DNA, 55 bp, Artificial Sequence
  Synthetic polynucleotide
ggcgtaatagcggcctctatttagtttattaggtcgtaaacaaatgctcgagtta

SEQ ID NO: 2580 - DNA, 55 bp, Artificial Sequence
  Synthetic polynucleotide
ttaaatagttccactgcaaccggcattattcggaaacagactttgtgatttctac

SEQ ID NO: 2581 - DNA, 55 bp, Artificial Sequence
  Synthetic polynucleotide
taggtagtacactgtacggacggattaattcggcaatatgcaataaagatctaac

SEQ ID NO: 2582 - DNA, 55 bp, Artificial Sequence
  Synthetic polynucleotide
tacgatgtcgacgctacatttccctagttagggtttattatggtttcaacagttg

SEQ ID NO: 2583 - DNA, 55 bp, Artificial Sequence
  Synthetic polynucleotide
gtataactctaccatgcaatggtcaaataatggcgtagagtcttctggaggaatt

SEQ ID NO: 2584 - DNA, 55 bp, Artificial Sequence
  Synthetic polynucleotide
catgtgcaggaaaaatcttggtcttagattagggacaagaacaaaggactattcg

SEQ ID NO: 2585 - DNA, 55 bp, Artificial Sequence
  Synthetic polynucleotide
atacttatctcgactgcaatacattgaaattgggaggcattgttcctgtaatcct

SEQ ID NO: 2586 - DNA, 55 bp, Artificial Sequence
  Synthetic polynucleotide
aatatctcatggagctcatagttcagctcaaggttcgtaattatcaggattgtga

SEQ ID NO: 2587 - DNA, 55 bp, Artificial Sequence
  Synthetic polynucleotide
agaggaaatatctaaacgctaaaggcatagagggtgtaatctattagttgcgacg

SEQ ID NO: 2588 - DNA, 55 bp, Artificial Sequence
  Synthetic polynucleotide
cttcaacccaacttggcccaaataaaggaagggttataactgtatcttcaacttg

SEQ ID NO: 2589 - DNA, 55 bp, Artificial Sequence
  Synthetic polynucleotide
actttctctatataaactttacttgtgcggtggatcttcggttcaacgttataac

SEQ ID NO: 2590 - DNA, 55 bp, Artificial Sequence
  Synthetic polynucleotide
agtaatacttatacgacatcacactagagtaggaatatgcttgtagcgtcctgta

SEQ ID NO: 2591 - DNA, 55 bp, Artificial Sequence
  Synthetic polynucleotide
cttatacttacgtgaactatgtgacaacagtggtaaaattcgacgccttagccaa

SEQ ID NO: 2592 - DNA, 55 bp, Artificial Sequence
  Synthetic polynucleotide
tataatgacaagatcacttaaggtcactgtaggtacattttaggaggcaaatgtt

SEQ ID NO: 2593 - DNA, 55 bp, Artificial Sequence
  Synthetic polynucleotide
aatttttaactatatgcttagcagactggcaggaccgttgtaactaaaggtatat

SEQ ID NO: 2594 - DNA, 55 bp, Artificial Sequence
  Synthetic polynucleotide
atagttggcagtccttctggtactgtttaatggtagcattcgtttctatgagccc

SEQ ID NO: 2595 - DNA, 55 bp, Artificial Sequence
  Synthetic polynucleotide
tttagttctctatattctttacacctttcacggtactcgccatcggaaggagcta

SEQ ID NO: 2596 - DNA, 55 bp, Artificial Sequence
  Synthetic polynucleotide
tgctaaggatgttgtgcccctctttcttctaggcaaacatagactggtaggctat

SEQ ID NO: 2597 - DNA, 55 bp, Artificial Sequence
  Synthetic polynucleotide
gtatttgattcgactacctattggcctttgtggcaaaccgaatagagttcactgt

SEQ ID NO: 2598 - DNA, 55 bp, Artificial Sequence
  Synthetic polynucleotide
tttaggtaccacatacctgcaagcttactttgggtgaacgatgataaactacctc

SEQ ID NO: 2599 - DNA, 55 bp, Artificial Sequence
  Synthetic polynucleotide
atttttcatatccgatcgtacgtactttcgtggaagctggttaaatgcgatcgtc

SEQ ID NO: 2600 - DNA, 55 bp, Artificial Sequence
  Synthetic polynucleotide
actatgtaaaacattacaataatgctgactggggtgaggtgatcgcagtcgtgta

SEQ ID NO: 2601 - DNA, 55 bp, Artificial Sequence
  Synthetic polynucleotide
ccataccgagatgtctctctcgaggtctcacggttataacatctaattcactaat

SEQ ID NO: 2602 - DNA, 55 bp, Artificial Sequence
  Synthetic polynucleotide
tggtgtaaaagtgaagcaagagcggtaatcgggtattcgtgtgattattttctcc

SEQ ID NO: 2603 - DNA, 55 bp, Artificial Sequence
  Synthetic polynucleotide
gatgagcctgattagcctaccaactcgaatcggcatagtaagttcataaagtact

SEQ ID NO: 2604 - DNA, 55 bp, Artificial Sequence
  Synthetic polynucleotide
tacgccgattaaactgcagcatcatgatgaaggattcgttccattcgttaaaagg

SEQ ID NO: 2605 - DNA, 55 bp, Artificial Sequence
  Synthetic polynucleotide
tatcataatcagtatcctattctatcgtgtcggtttgaggatatcacagccggag

SEQ ID NO: 2606 - DNA, 55 bp, Artificial Sequence
  Synthetic polynucleotide
actgattaggtgaacccgcagttataacgctggagtgattcaggtattcacctct

SEQ ID NO: 2607 - DNA, 55 bp, Artificial Sequence
  Synthetic polynucleotide
tcatcccccataagaactacagttacccagtgggagcacagggttaaaaagcttt

SEQ ID NO: 2608 - DNA, 55 bp, Artificial Sequence
  Synthetic polynucleotide
taatccggtaacaccgcaataaagacaggacggttattctaccagtcccttacgt

SEQ ID NO: 2609 - DNA, 55 bp, Artificial Sequence
  Synthetic polynucleotide
tgatacccggacactcctcgtgcgatttagtggattcttcagctattgcacacgt

SEQ ID NO: 2610 - DNA, 55 bp, Artificial Sequence
  Synthetic polynucleotide
ggcttgcagcaattctcattcggctaaaatcgggaagtgaacatgtggtgcaacg

SEQ ID NO: 2611 - DNA, 55 bp, Artificial Sequence
  Synthetic polynucleotide
agccgcatgacctttacagactgtatttactgggtgatccggcttagcctctctt

SEQ ID NO: 2612 - DNA, 55 bp, Artificial Sequence
  Synthetic polynucleotide
gatcttcagttcgagcctttcatggtaacctggacctgccttacatccgcgtcgg

SEQ ID NO: 2613 - DNA, 55 bp, Artificial Sequence
  Synthetic polynucleotide
gtcctgtcggtgaagcccccgatgtagtataggaaatcaatactacctccttcgt

SEQ ID NO: 2614 - DNA, 55 bp, Artificial Sequence
  Synthetic polynucleotide
agtgatctagcgccgacattagcgatattgcggtatctgttcacaaacagcgacg

SEQ ID NO: 2615 - DNA, 55 bp, Artificial Sequence
  Synthetic polynucleotide
cggtgcagcaccctaacacgcttaagagctaggggttgcgccagaccacgttaac

SEQ ID NO: 2616 - DNA, 55 bp, Artificial Sequence
  Synthetic polynucleotide
acctttccgttacctgcgcttgcgactaactggttcagataatccactatgagga

SEQ ID NO: 2617 - DNA, 55 bp, Artificial Sequence
  Synthetic polynucleotide
ctagctccaacagtaaccagtgcattaccagggaaatcgagtctccctcttcgtc

SEQ ID NO: 2618 - DNA, 55 bp, Artificial Sequence
  Synthetic polynucleotide
tagggctaggctcgcactttcctacctaccgggagagaggtagtgggagcgtaga

SEQ ID NO: 2619 - DNA, 55 bp, Artificial Sequence
  Synthetic polynucleotide
gcgtgcatcccccttcccatgtcgcacggaaggtcggaaaatgcaagcgacctac

SEQ ID NO: 2620 - DNA, 55 bp, Artificial Sequence
  Synthetic polynucleotide
tcacatttcccgtacactctgatgattcggaggatttcaaccgccccctgaccca

SEQ ID NO: 2621 - DNA, 55 bp, Artificial Sequence
  Synthetic polynucleotide
cgttatagccaacctactactctgaccagacggcaaaaagtgctgggagtacgtt

SEQ ID NO: 2622 - DNA, 55 bp, Artificial Sequence
  Synthetic polynucleotide
gtagattccgacacacccagcatcatcagcaggggagtaaagcggacctgtgtgt

SEQ ID NO: 2623 - DNA, 55 bp, Artificial Sequence
  Synthetic polynucleotide
ggcccaccctcgcctgctatgttccaacaaaggcataatcgacgaccctgcgttt

SEQ ID NO: 2624 - DNA, 55 bp, Artificial Sequence
  Synthetic polynucleotide
ggcgcgggctctcaccccgcctcggtatttaggtttagctgcgcagcagcgcctg

SEQ ID NO: 2625 - DNA, 55 bp, Artificial Sequence
  Synthetic polynucleotide
cgcgactgcactggcgcacgaggcggttctaggttccccccaccttcccctaggg

SEQ ID NO: 2626 - DNA, 55 bp, Artificial Sequence
  Synthetic polynucleotide
gcagtgacaccccttccatcgccactttcggggcgggaatggaaggcctctcgct

SEQ ID NO: 2627 - DNA, 55 bp, Artificial Sequence
  Synthetic polynucleotide
cggtatcggctcctcccgtgccactttccaaggagggcaaagagcgtatcggtcc

SEQ ID NO: 2628 - DNA, 55 bp, Artificial Sequence
  Synthetic polynucleotide
cggcaaacgtcgccagctgttagtcatttagggtgaggctcggcgggcccacgcc

SEQ ID NO: 2629 - DNA, 55 bp, Artificial Sequence
  Synthetic polynucleotide
acggcccctcgcgcaacggcggtttctaaagggtctttctcgaaagaacgcggcg

SEQ ID NO: 2630 - DNA, 55 bp, Artificial Sequence
  Synthetic polynucleotide
ctcgtacctctcccaacactcaccgtccgttgggtggggaggcgcagactctgcc

SEQ ID NO: 2631 - DNA, 55 bp, Artificial Sequence
  Synthetic polynucleotide
tgcaacggtccttccactgttacgatcgatgggctggggggcaggggtgccgcgg

SEQ ID NO: 2632 - DNA, 55 bp, Artificial Sequence
  Synthetic polynucleotide
ttgctgccgccgccgccctccatccatgtggggtccatgcactttggcacgttca

SEQ ID NO: 2633 - DNA, 55 bp, Artificial Sequence
  Synthetic polynucleotide
agatggttcgagcaacctacctacgccgcaagggaggggcgagtgtggggaggga

SEQ ID NO: 2634 - DNA, 55 bp, Artificial Sequence
  Synthetic polynucleotide
cgcccgactgcacatgctccccgactaagtaggactaggcggccagttcgtcgtt

SEQ ID NO: 2635 - DNA, 55 bp, Artificial Sequence
  Synthetic polynucleotide
agctccctccccctctccagctgcccctgcgggttcggacgaattaggtcgttgg

SEQ ID NO: 2636 - DNA, 55 bp, Artificial Sequence
  Synthetic polynucleotide
gcagccgcactgtcgactcttctaaaccgacggatcagtggggaggcacgcacct

SEQ ID NO: 2637 - DNA, 55 bp, Artificial Sequence
  Synthetic polynucleotide
accgccctcaacgcaccgtaagaacaaagaaggctaggggccggggcctttcagg

SEQ ID NO: 2638 - DNA, 55 bp, Artificial Sequence
  Synthetic polynucleotide
agtgcatgcaaacgcccctttatacatcggcggacatcggtggccggggcaggcc

SEQ ID NO: 2639 - DNA, 55 bp, Artificial Sequence
  Synthetic polynucleotide
atgtgaaatataaataccgcgatctttatttggaaacctctaacttttagttgca

SEQ ID NO: 2640 - DNA, 55 bp, Artificial Sequence
  Synthetic polynucleotide
agcatactaagaacatcgcctgaaataatgaggtttaaatggacacaaaagtaat

SEQ ID NO: 2641 - DNA, 55 bp, Artificial Sequence
  Synthetic polynucleotide
ttaattttcttctatcctacttgatattatagggttgctgttggatcctagatca

SEQ ID NO: 2642 - DNA, 55 bp, Artificial Sequence
  Synthetic polynucleotide
catatgaattcatcaacattgtcttcttatagggtctcaatttaaggatagcaca

SEQ ID NO: 2643 - DNA, 55 bp, Artificial Sequence
  Synthetic polynucleotide
ctgaacaatctttatgctcatgcaataatacggtcatggtatctattaaaaggat

SEQ ID NO: 2644 - DNA, 55 bp, Artificial Sequence
  Synthetic polynucleotide
atataatgaagcatgtcagtaaacgaattttggcgattttacgactaactggaat

SEQ ID NO: 2645 - DNA, 55 bp, Artificial Sequence
  Synthetic polynucleotide
ttcaaagcatgactatcaatatggtggaatcggaattacaaagtcttgaaaagta

SEQ ID NO: 2646 - DNA, 55 bp, Artificial Sequence
  Synthetic polynucleotide
taacttgtccagatgtccagttaacaaatacggttaataactaactattgtactt

SEQ ID NO: 2647 - DNA, 55 bp, Artificial Sequence
  Synthetic polynucleotide
acttcataaatataatctagcaaatttcaagggaaatacaacgatattctttcta

SEQ ID NO: 2648 - DNA, 55 bp, Artificial Sequence
  Synthetic polynucleotide
aaatcggaatttgactcggattaccagacatggatataaagagtagaatatgatt

SEQ ID NO: 2649 - DNA, 55 bp, Artificial Sequence
  Synthetic polynucleotide
cattccaatgtttatcctgtaatgcaagtatggaatgggacatttctaattattc

SEQ ID NO: 2650 - DNA, 55 bp, Artificial Sequence
  Synthetic polynucleotide
ggacaatttaaattatccatgcataaaagcggggtaaacataattaaacataata

SEQ ID NO: 2651 - DNA, 55 bp, Artificial Sequence
  Synthetic polynucleotide
atagtttgaataacatcgactatacaagaagggtacatttgcaaagtgcatcaat

SEQ ID NO: 2652 - DNA, 55 bp, Artificial Sequence
  Synthetic polynucleotide
aacatctttaaatgcccagtgaaagaccagaggtattattacgataaaaatcgaa

SEQ ID NO: 2653 - DNA, 55 bp, Artificial Sequence
  Synthetic polynucleotide
taagtgtaaagtaatgctatagtaaaacgtagggagaactatttctatttcaagg

SEQ ID NO: 2654 - DNA, 55 bp, Artificial Sequence
  Synthetic polynucleotide
tagctcaacctacatccgtaaaggttatttaggagtaaaaggactgatgaataat

SEQ ID NO: 2655 - DNA, 55 bp, Artificial Sequence
  Synthetic polynucleotide
atcgagtattagaattctgcgtccatattaaggcgttacggtacttttccaagaa

SEQ ID NO: 2656 - DNA, 55 bp, Artificial Sequence
  Synthetic polynucleotide
ttaccacttgattattcaatgactttaactcggctgatggtcatccaatggacac

SEQ ID NO: 2657 - DNA, 55 bp, Artificial Sequence
  Synthetic polynucleotide
catagaggctcatactcactagttgtttagcggacactcttaaaaaattcggcta

SEQ ID NO: 2658 - DNA, 55 bp, Artificial Sequence
  Synthetic polynucleotide
caccaaactaagatgccccattgcacaaattggtgttgattagaacatcattgaa

SEQ ID NO: 2659 - DNA, 55 bp, Artificial Sequence
  Synthetic polynucleotide
atcatcttgatacatccgaatcgcataatgcgggttggttagccatctaaattgt

SEQ ID NO: 2660 - DNA, 55 bp, Artificial Sequence
  Synthetic polynucleotide
ttaacaaagaaatagccctgtcaggctatacgggtattcatggaaatctcttttg

SEQ ID NO: 2661 - DNA, 55 bp, Artificial Sequence
  Synthetic polynucleotide
tcccgaaaataaagtccaacgttagatatgaggatttgttcactttttacctatg

SEQ ID NO: 2662 - DNA, 55 bp, Artificial Sequence
  Synthetic polynucleotide
tacttatccccaacttcccgaaatgcggttaggtgctgttaaaccaattatttct

SEQ ID NO: 2663 - DNA, 55 bp, Artificial Sequence
  Synthetic polynucleotide
catcgtaagttcaaatccgtcttacaagaacggatacaacatatatatgtttacc

SEQ ID NO: 2664 - DNA, 55 bp, Artificial Sequence
  Synthetic polynucleotide
attttctattgtcagtcaggaatccgaaacaggcctaacttatcttgaaactaag

SEQ ID NO: 2665 - DNA, 55 bp, Artificial Sequence
  Synthetic polynucleotide
ttaaccatcagaacccctcgatgtttgctaagggtttagataaacgcatattggt

SEQ ID NO: 2666 - DNA, 55 bp, Artificial Sequence
  Synthetic polynucleotide
ttagctatagataagtcaatctagctgtgatggcggtacggcataaagtattcga

SEQ ID NO: 2667 - DNA, 55 bp, Artificial Sequence
  Synthetic polynucleotide
attatatagattacttcctgatcacaagactgggtatgatcaggcttctcgtgtt

SEQ ID NO: 2668 - DNA, 55 bp, Artificial Sequence
  Synthetic polynucleotide
aattcagcagtatcctccgagaacttgggttggtatattgatgtaaatggtagag

SEQ ID NO: 2669 - DNA, 55 bp, Artificial Sequence
  Synthetic polynucleotide
tctgggtactatatatcgtttactatttaccggcgatccggtgtatgacccaatc

SEQ ID NO: 2670 - DNA, 55 bp, Artificial Sequence
  Synthetic polynucleotide
gccatgaaccgacactcgttggctttaaatgggggtagtaattacacttgaatta

SEQ ID NO: 2671 - DNA, 55 bp, Artificial Sequence
  Synthetic polynucleotide
cttttgaaacctgggactgaagggatttagaggttagtccacacaccacaacagt

SEQ ID NO: 2672 - DNA, 55 bp, Artificial Sequence
  Synthetic polynucleotide
atccccagaactgacgcatactgggtaataaggagtcacgaatacttcagtagtg

SEQ ID NO: 2673 - DNA, 55 bp, Artificial Sequence
  Synthetic polynucleotide
ccgattgaactcctttcggtttagtctaaccggtcaatagcatatgtaaacttcg

SEQ ID NO: 2674 - DNA, 55 bp, Artificial Sequence
  Synthetic polynucleotide
tgcccacttactttctcgctttcattctcagggaggctattaagttcatcggcat

SEQ ID NO: 2675 - DNA, 55 bp, Artificial Sequence
  Synthetic polynucleotide
gaaacatacttacgttcccgattactatacgggcgagggtctaaaggaaatgtca

SEQ ID NO: 2676 - DNA, 55 bp, Artificial Sequence
  Synthetic polynucleotide
cgaccgtagcaagaatcaacacttacaaaccgggtctgtgggaataacgcaaata

SEQ ID NO: 2677 - DNA, 55 bp, Artificial Sequence
  Synthetic polynucleotide
aatatctgaagcttaacagcggagtactcaggggatccaagatgtctgcatgatc

SEQ ID NO: 2678 - DNA, 55 bp, Artificial Sequence
  Synthetic polynucleotide
tgtggacttaacaggaccgttgtagttagccggactatatttcgagaactctttg

SEQ ID NO: 2679 - DNA, 55 bp, Artificial Sequence
  Synthetic polynucleotide
agggtgtttacattaacgatcaaccatagccggcccgatttgttttaagcacaat

SEQ ID NO: 2680 - DNA, 55 bp, Artificial Sequence
  Synthetic polynucleotide
ttgtactccacatccgctcagacaggtgaatggatagtcgtgaaagatcgtataa

SEQ ID NO: 2681 - DNA, 55 bp, Artificial Sequence
  Synthetic polynucleotide
tcgctattaaaacgcacaacagatttcagaagggtctgcaggacaagcttagaat

SEQ ID NO: 2682 - DNA, 55 bp, Artificial Sequence
  Synthetic polynucleotide
cttatcctatacgcaccaagtgatgattgttggataatggttctaccgtaagccc

SEQ ID NO: 2683 - DNA, 55 bp, Artificial Sequence
  Synthetic polynucleotide
tgaattctgtgagactccacacgtaaacggtggttcgttaatcagaatgggtttc

SEQ ID NO: 2684 - DNA, 55 bp, Artificial Sequence
  Synthetic polynucleotide
caagtaccccaccatgcccgatggaattaaaggacttcggggtcagtctaagtgc

SEQ ID NO: 2685 - DNA, 55 bp, Artificial Sequence
  Synthetic polynucleotide
acttactcgcatcatgctcggccctattatgggtttttccaggttggtcggggtc

SEQ ID NO: 2686 - DNA, 55 bp, Artificial Sequence
  Synthetic polynucleotide
taatagaatcgcatacctatccgtttattatgggggcacttgcaagggtgggcca

SEQ ID NO: 2687 - DNA, 55 bp, Artificial Sequence
  Synthetic polynucleotide
gcgtcgaccagtaaccccaatcgtttctttaggaaaagtacacttaccgacccgt

SEQ ID NO: 2688 - DNA, 55 bp, Artificial Sequence
  Synthetic polynucleotide
cgtaggtaatcaggtgcgcgccgtcgattacggaaaattcttacacaattcactg

SEQ ID NO: 2689 - DNA, 55 bp, Artificial Sequence
  Synthetic polynucleotide
aggggactacagcagacgttcggggaaatttggctgacgtacaaagataaaggtc

SEQ ID NO: 2690 - DNA, 55 bp, Artificial Sequence
  Synthetic polynucleotide
ggaggatccagttatacacggcaatttacctggcgatgtcgctaagtttagcaca

SEQ ID NO: 2691 - DNA, 55 bp, Artificial Sequence
  Synthetic polynucleotide
cctcctgtttcggggccaaccggtgaaaacaggagataacattctcacaaagtca

SEQ ID NO: 2692 - DNA, 55 bp, Artificial Sequence
  Synthetic polynucleotide
cgcaaacaatagcacgcaaaaaaggttctccgggtaaagagtcggcggaacgtag

SEQ ID NO: 2693 - DNA, 55 bp, Artificial Sequence
  Synthetic polynucleotide
tatacagaagtgcattctgagtcaggaccctggccaccctttctacggtgtcaat

SEQ ID NO: 2694 - DNA, 55 bp, Artificial Sequence
  Synthetic polynucleotide
gcgatgaacttacccgccataacgccgcatagggatagtttctcggggtggttct

SEQ ID NO: 2695 - DNA, 55 bp, Artificial Sequence
  Synthetic polynucleotide
tcgtcgccccgagagtccagtatgttaggatggttgctcaaactctatccgaccg

SEQ ID NO: 2696 - DNA, 55 bp, Artificial Sequence
  Synthetic polynucleotide
tagtacaagtcataccctaacgatcacacgggggtaggtgcaaccgacaggtttg

SEQ ID NO: 2697 - DNA, 55 bp, Artificial Sequence
  Synthetic polynucleotide
tctgccatatttaaggcgacgttatatcgctggcctcgaggacatcctgccgtct

SEQ ID NO: 2698 - DNA, 55 bp, Artificial Sequence
  Synthetic polynucleotide
aaggcatgcggtacttcaaattgacactgaagggcagctccccgtgggcctgcat

SEQ ID NO: 2699 - DNA, 55 bp, Artificial Sequence
  Synthetic polynucleotide
tcgtcgccccggttggctttcctacttctaaggaaagcgtccctcgagcggtgcg

SEQ ID NO: 2700 - DNA, 55 bp, Artificial Sequence
  Synthetic polynucleotide
cgcccaagaaggcatccgtgttctatttctggggcttgagcagcgccgcggtccc

SEQ ID NO: 2701 - DNA, 55 bp, Artificial Sequence
  Synthetic polynucleotide
aaagcccagcctttcgcccttcgtctttcatggcaacgtgagggcagccggcccg

SEQ ID NO: 2702 - DNA, 55 bp, Artificial Sequence
  Synthetic polynucleotide
gctacgcatctgccctcgggacgcgtctaagggtagaaagaatgtccccctcggg

SEQ ID NO: 2703 - DNA, 55 bp, Artificial Sequence
  Synthetic polynucleotide
gggcgcttcctcgtctctcatacggcaattgggagacgagaccgccccacccgga

SEQ ID NO: 2704 - DNA, 55 bp, Artificial Sequence
  Synthetic polynucleotide
gcttgcgagttccgtccgctgtgtcatacagggatcacggaacgggtggggtccc

SEQ ID NO: 2705 - DNA, 55 bp, Artificial Sequence
  Synthetic polynucleotide
cagccccacgggccgtcgcattggtccaaatggaagtgatcgctcctgagcgacc

SEQ ID NO: 2706 - DNA, 55 bp, Artificial Sequence
  Synthetic polynucleotide
gcgccggcgtgctgcccctggagttcacataggggacttcacgattacctcagcg

SEQ ID NO: 2707 - DNA, 55 bp, Artificial Sequence
  Synthetic polynucleotide
acccgcctcaagcacgcgacgctgcaatactggaggtcaggattcagccgggctc

SEQ ID NO: 2708 - DNA, 55 bp, Artificial Sequence
  Synthetic polynucleotide
cctatggctgtgcgcgcttcctacgatagagggatgtcggggcgggggttgccca

SEQ ID NO: 2709 - DNA, 55 bp, Artificial Sequence
  Synthetic polynucleotide
ctctcccctcgcactacagctcttcacgcaggggaactgaactcggagcgcaggc

SEQ ID NO: 2710 - DNA, 55 bp, Artificial Sequence
  Synthetic polynucleotide
tctgggaggtcctccacttgccactacaacgggtgggtcgtcggttcccctgggt

SEQ ID NO: 2711 - DNA, 55 bp, Artificial Sequence
  Synthetic polynucleotide
agtgtgtaccatacccccgaactacaccgcgggggacgtgcgcatgccgcccact

SEQ ID NO: 2712 - DNA, 55 bp, Artificial Sequence
  Synthetic polynucleotide
ggacccactccttgagcaatcacgtacgtgtggtcgttggccctacgttgcccgc

SEQ ID NO: 2713 - DNA, 55 bp, Artificial Sequence
  Synthetic polynucleotide
tcgaaggcagagtagcccgtgactcaacgttggtctggggtagcgccgtccatgc

SEQ ID NO: 2714 - DNA, 55 bp, Artificial Sequence
  Synthetic polynucleotide
gagttgaaagaagatacattaaactttattcggtgattcactgatcaacatcgtt

SEQ ID NO: 2715 - DNA, 55 bp, Artificial Sequence
  Synthetic polynucleotide
atgccacagctattatctgtaagattaaattggtaacacgctgtacttaaatttc

SEQ ID NO: 2716 - DNA, 55 bp, Artificial Sequence
  Synthetic polynucleotide
ttctcattgcgattcgcatatctaatttaaaggcaaaattgcaaagcagcttttt

SEQ ID NO: 2717 - DNA, 55 bp, Artificial Sequence
  Synthetic polynucleotide
tcttattttcaatgtaccggagctaatttcagggatcttcaaaataggatttaca

SEQ ID NO: 2718 - DNA, 55 bp, Artificial Sequence
  Synthetic polynucleotide
gggaataatttatcctcacttcttgctgtttgggtttggttatgaattatcaaaa

SEQ ID NO: 2719 - DNA, 55 bp, Artificial Sequence
  Synthetic polynucleotide
tagttcaaactaaacgcttcacggttatagaggaattttagtttttccgttattt

SEQ ID NO: 2720 - DNA, 55 bp, Artificial Sequence
  Synthetic polynucleotide
ctatttttttttgattccagggaaattacgtggctattgatcaaatttatgtaca

SEQ ID NO: 2721 - DNA, 55 bp, Artificial Sequence
  Synthetic polynucleotide
ttacttaattttagagcattatccaaagaatggaaattccgaactgtatctcatc

SEQ ID NO: 2722 - DNA, 55 bp, Artificial Sequence
  Synthetic polynucleotide
atttgctaattctaatcataacataatatatggtttgacatcggtatcccaaatg

SEQ ID NO: 2723 - DNA, 55 bp, Artificial Sequence
  Synthetic polynucleotide
ttctaagattgtattacgtcaagtatatgcaggtacctactcgtgaaattttatc

SEQ ID NO: 2724 - DNA, 55 bp, Artificial Sequence
  Synthetic polynucleotide
atcatctttaaataacctggttagaaacacagggtgctagatgatttaataattg

SEQ ID NO: 2725 - DNA, 55 bp, Artificial Sequence
  Synthetic polynucleotide
aagggcaagcgttattcatatatagaggaatggccgtaaaattatgtgttaataa

SEQ ID NO: 2726 - DNA, 55 bp, Artificial Sequence
  Synthetic polynucleotide
gttggaatatgaatgtccaataaattgtgatggctactatagatcccaatacaaa

SEQ ID NO: 2727 - DNA, 55 bp, Artificial Sequence
  Synthetic polynucleotide
aaaaaggtttaaacttcgagatttaactgtcggaattgtgatttgaatcgcatta

SEQ ID NO: 2728 - DNA, 55 bp, Artificial Sequence
  Synthetic polynucleotide
ttctaatgaatatgaacaacagaagattgttggacacctagttaccatagatctt

SEQ ID NO: 2729 - DNA, 55 bp, Artificial Sequence
  Synthetic polynucleotide
ctgcaatctacaaactcagctgcttaaatttggtatcttacctaacaacgctttg

SEQ ID NO: 2730 - DNA, 55 bp, Artificial Sequence
  Synthetic polynucleotide
tatatcaaataatgtactcttgctgaatttcggatgggtgtattacgaacccagc

SEQ ID NO: 2731 - DNA, 55 bp, Artificial Sequence
  Synthetic polynucleotide
cagccaatcagctctacttctatattattcaggaaatatggcacactctagagta

SEQ ID NO: 2732 - DNA, 55 bp, Artificial Sequence
  Synthetic polynucleotide
gagctttttatatgcgctgacctttaatcttgggggcaatagtgatatgtgagtt

SEQ ID NO: 2733 - DNA, 55 bp, Artificial Sequence
  Synthetic polynucleotide
ggttacccacatcggtcgatttatcgttctgggtaaaatacttaagattaggaag

SEQ ID NO: 2734 - DNA, 55 bp, Artificial Sequence
  Synthetic polynucleotide
atattctttaaacaggccgtacggaaatttagggttctctcatgtttagccggaa

SEQ ID NO: 2735 - DNA, 55 bp, Artificial Sequence
  Synthetic polynucleotide
tgcctgctgcctactacaaggttctcaatccggataatgattttcatctttctta

SEQ ID NO: 2736 - DNA, 55 bp, Artificial Sequence
  Synthetic polynucleotide
ctgcgttaattaaggacccaaacgaatacaaggtcgccttagtatttctaagtga

SEQ ID NO: 2737 - DNA, 55 bp, Artificial Sequence
  Synthetic polynucleotide
cggaacttcgtctcatcaggggaatgcttaaggtttatggtagatagtcatatta

SEQ ID NO: 2738 - DNA, 55 bp, Artificial Sequence
  Synthetic polynucleotide
gctaattcttatatttcctatctctctcgatggtaggctcggcactgacttttaa

SEQ ID NO: 2739 - DNA, 55 bp, Artificial Sequence
  Synthetic polynucleotide
atacacattgagtataccacatcccgtgttaggatctgccgaatgtttacttgtt

SEQ ID NO: 2740 - DNA, 55 bp, Artificial Sequence
  Synthetic polynucleotide
aggtctattacatgtactaattctagcatcggggggataaaaattctatgtttag

SEQ ID NO: 2741 - DNA, 55 bp, Artificial Sequence
  Synthetic polynucleotide
tactcaaagaacctgccggatgatgacatttggaacttatttctcaaccgatatg

SEQ ID NO: 2742 - DNA, 55 bp, Artificial Sequence
  Synthetic polynucleotide
caatgaaatggtatggcttgataatcacgctggttagaatacgctcagatttatc

SEQ ID NO: 2743 - DNA, 55 bp, Artificial Sequence
  Synthetic polynucleotide
ttatgagatccgataacggtatagaactgcaggatcatccaatttttgttaagaa

SEQ ID NO: 2744 - DNA, 55 bp, Artificial Sequence
  Synthetic polynucleotide
gttctcttacaattggcagtcctttaaatttggacactttgatggacaccgtctg

SEQ ID NO: 2745 - DNA, 55 bp, Artificial Sequence
  Synthetic polynucleotide
aaacgcggtctttgttctacctagttaataaggtcaaagtgcaggatggagttag

SEQ ID NO: 2746 - DNA, 55 bp, Artificial Sequence
  Synthetic polynucleotide
tcagagcgttcgacagctgcattaataattcggtagtagcttgcatggtcagtga

SEQ ID NO: 2747 - DNA, 55 bp, Artificial Sequence
  Synthetic polynucleotide
tagaatgtttattctccaactacccaaaacggggaatgccaatagacttagccgg

SEQ ID NO: 2748 - DNA, 55 bp, Artificial Sequence
  Synthetic polynucleotide
tcctttcacagtacagcgactaataattatcggatgcgggcaattattgggatac

SEQ ID NO: 2749 - DNA, 55 bp, Artificial Sequence
  Synthetic polynucleotide
tgtctttcattacctcctcatcctgatcttaggaggctactacggtagttgcaac

SEQ ID NO: 2750 - DNA, 55 bp, Artificial Sequence
  Synthetic polynucleotide
tagcttgggttccgctcgtattgaacgtacaggactttggtgtgttttagcttac

SEQ ID NO: 2751 - DNA, 55 bp, Artificial Sequence
  Synthetic polynucleotide
aaacagcacacagcaccctaggtcacaatctggaatttgcaagttctacgttagg

SEQ ID NO: 2752 - DNA, 55 bp, Artificial Sequence
  Synthetic polynucleotide
cgagtcgttacatccacttcgtaaacatactggaagaggtcacctaattggcata

SEQ ID NO: 2753 - DNA, 55 bp, Artificial Sequence
  Synthetic polynucleotide
acggtatttatcggtacgtcactatctcaatggaagagtgctcagtctgtgtaag

SEQ ID NO: 2754 - DNA, 55 bp, Artificial Sequence
  Synthetic polynucleotide
attaaacattagcggccactcccgagtataaggtatggagcatacactacgttgg

SEQ ID NO: 2755 - DNA, 55 bp, Artificial Sequence
  Synthetic polynucleotide
tagtctatatgaacatctacggacaaaccgtggcactccgttgttgagctgttga

SEQ ID NO: 2756 - DNA, 55 bp, Artificial Sequence
  Synthetic polynucleotide
ctatagataatggcttcatgatttctccgcaggaccctaaaccgtgctatcgatc

SEQ ID NO: 2757 - DNA, 55 bp, Artificial Sequence
  Synthetic polynucleotide
cacattatatcttgggcacataattaccgatggatacgtgatggcgatagtgcca

SEQ ID NO: 2758 - DNA, 55 bp, Artificial Sequence
  Synthetic polynucleotide
tttattgttcaaagcacggataaccacggttggtagacgtaggcattctacaaca

SEQ ID NO: 2759 - DNA, 55 bp, Artificial Sequence
  Synthetic polynucleotide
ataccgagctgctttccaaaaggctttatccggaagagttcgaacgtcatcgggc

SEQ ID NO: 2760 - DNA, 55 bp, Artificial Sequence
  Synthetic polynucleotide
caagagatcccaatggcgcggcccttatttggggtttctataactgaactctact

SEQ ID NO: 2761 - DNA, 55 bp, Artificial Sequence
  Synthetic polynucleotide
ctgaagttgtaaccctctggttatgtatttaggccactagggcgagttttgggac

SEQ ID NO: 2762 - DNA, 55 bp, Artificial Sequence
  Synthetic polynucleotide
cgttgaatcgtgagaacgcggtctataactggggacactgactgatcctacgact

SEQ ID NO: 2763 - DNA, 55 bp, Artificial Sequence
  Synthetic polynucleotide
cacctttaaccccccccttgtctcctgatttggcaagatcactaagttagtaggt

SEQ ID NO: 2764 - DNA, 55 bp, Artificial Sequence
  Synthetic polynucleotide
cgtgtgttccaccgtgctgtggtcacataatggcttttctctcacgatggcccga

SEQ ID NO: 2765 - DNA, 55 bp, Artificial Sequence
  Synthetic polynucleotide
caccaccctaataaaacgaattgatagttacgggcacggtgggctggcgatggtc

SEQ ID NO: 2766 - DNA, 55 bp, Artificial Sequence
  Synthetic polynucleotide
ccatgactcatccccacaactaagtcaatacggtggtctcgggtaagcgcgatac

SEQ ID NO: 2767 - DNA, 55 bp, Artificial Sequence
  Synthetic polynucleotide
agctgtcacgatttagcacgaaagtttgccaggacagtatagcgtacgtgatagc

SEQ ID NO: 2768 - DNA, 55 bp, Artificial Sequence
  Synthetic polynucleotide
ttcatgagcaaacatgccatatcgtcgctagggagtgtaacttagtctacggccc

SEQ ID NO: 2769 - DNA, 55 bp, Artificial Sequence
  Synthetic polynucleotide
cgtagcgacagcactactttgcgacaaccttggtaggtatctggtagggttatag

SEQ ID NO: 2770 - DNA, 55 bp, Artificial Sequence
  Synthetic polynucleotide
gtctcgcctgagtccgcattatacttgatgggggcggtgagatgagggatttacc

SEQ ID NO: 2771 - DNA, 55 bp, Artificial Sequence
  Synthetic polynucleotide
gctctaaaatcacccacagcttattgacggtggataaccgccccggcgccagcag

SEQ ID NO: 2772 - DNA, 55 bp, Artificial Sequence
  Synthetic polynucleotide
gcagttgcccatgcagcgagcattcttgggtggacttacagtatgcttgaccata

SEQ ID NO: 2773 - DNA, 55 bp, Artificial Sequence
  Synthetic polynucleotide
ggagtacgaatcttaaccttactcaagagagggggtcggcgagctctgtttcagg

SEQ ID NO: 2774 - DNA, 55 bp, Artificial Sequence
  Synthetic polynucleotide
cctgagcatcaacgtgcaacccccctttctagggggacttgtatgcggccacggg

SEQ ID NO: 2775 - DNA, 55 bp, Artificial Sequence
  Synthetic polynucleotide
cttagcctgcacctctcacccgtcttgtttcgggagacgcgaggcaggccctcct

SEQ ID NO: 2776 - DNA, 55 bp, Artificial Sequence
  Synthetic polynucleotide
agcgtagcacccccctcgtcctaagatttcgggcaacggcgcgcatacacacacg

SEQ ID NO: 2777 - DNA, 55 bp, Artificial Sequence
  Synthetic polynucleotide
gatccgccggtgcgagccttcgtatcctatgggaacttgaggttcagcggggctc

SEQ ID NO: 2778 - DNA, 55 bp, Artificial Sequence
  Synthetic polynucleotide
gcgtaaaaggcgggctcattgggaacttccaggtaccacccggttcccgccggct

SEQ ID NO: 2779 - DNA, 55 bp, Artificial Sequence
  Synthetic polynucleotide
cagtcagatcccgcgccgagccatccatctggggtctgggatcggctagagtcac

SEQ ID NO: 2780 - DNA, 55 bp, Artificial Sequence
  Synthetic polynucleotide
ggtgcccccttcacatcaatacattgctctgggggcgtggctcccggtgcaaggc

SEQ ID NO: 2781 - DNA, 55 bp, Artificial Sequence
  Synthetic polynucleotide
gcgtactccatcgacgcctcactctttgtcagggtccgggtataggacgccgctg

SEQ ID NO: 2782 - DNA, 55 bp, Artificial Sequence
  Synthetic polynucleotide
gaggttcccccagcgccggtccaagtctgaaggatcctgactagctagcgcccaa

SEQ ID NO: 2783 - DNA, 55 bp, Artificial Sequence
  Synthetic polynucleotide
agcctgctttaacgtccagcatatcccgtcgggtatagggggcgtccacggtgcc

SEQ ID NO: 2784 - DNA, 55 bp, Artificial Sequence
  Synthetic polynucleotide
cgcccctcacatgcaccagatgaattcatggggggggcgtcactgcaccacggtt

SEQ ID NO: 2785 - DNA, 55 bp, Artificial Sequence
  Synthetic polynucleotide
ttttccgtgcaaccaacacagcacatgcgttggggcgtcctcgggagccgcgcga

SEQ ID NO: 2786 - DNA, 55 bp, Artificial Sequence
  Synthetic polynucleotide
ttccccgacgaaatgccactaccacacagtgggccaggcttgaggacgagcctcg

SEQ ID NO: 2787 - DNA, 55 bp, Artificial Sequence
  Synthetic polynucleotide
gtacgcctacccgttccccacgtacacagcgggaagtctagatgctcccgatgcc

SEQ ID NO: 2788 - DNA, 55 bp, Artificial Sequence
  Synthetic polynucleotide
cgcgacccccattaccctcattactaccgctggtaggcagccggatgcttgctcg

SEQ ID NO: 2789 - DNA, 55 bp, Artificial Sequence
  Synthetic polynucleotide
ttaattctacagtattcattcattctttaagggtttttggttatcctgggtcaca

SEQ ID NO: 2790 - DNA, 55 bp, Artificial Sequence
  Synthetic polynucleotide
tagatcctacgccatccttcttatattaactggaaaacttgtttcaaatatagta

SEQ ID NO: 2791 - DNA, 55 bp, Artificial Sequence
  Synthetic polynucleotide
gctaaggtttaaacttctaccgagtaaatttggaaattctattggtcttcgtata

SEQ ID NO: 2792 - DNA, 55 bp, Artificial Sequence
  Synthetic polynucleotide
tagcatttgctctatgcatagaataaaacttggagagcaactttcgatagaataa

SEQ ID NO: 2793 - DNA, 55 bp, Artificial Sequence
  Synthetic polynucleotide
tgatttttttggtaacctatgatataatactggctcttgtaagtgtttaatcttt

SEQ ID NO: 2794 - DNA, 55 bp, Artificial Sequence
  Synthetic polynucleotide
gttccgactcgttgatctaatactaaaatcagggtcaatatattttccagatttt

SEQ ID NO: 2795 - DNA, 55 bp, Artificial Sequence
  Synthetic polynucleotide
atagggtaagctatgccattaaaaaaattccggactactttacaaaattgacttt

SEQ ID NO: 2796 - DNA, 55 bp, Artificial Sequence
  Synthetic polynucleotide
agaataataaacagaacgtgtttacgatctgggtcactagtaatgaaagaatagt

SEQ ID NO: 2797 - DNA, 55 bp, Artificial Sequence
  Synthetic polynucleotide
acatctaactattaagcattattgctgttcaggtacagaattatttggttaacat

SEQ ID NO: 2798 - DNA, 55 bp, Artificial Sequence
  Synthetic polynucleotide
agtaactgaggttatgcacaataaaatagttggcacttctatgtcaccataatta

SEQ ID NO: 2799 - DNA, 55 bp, Artificial Sequence
  Synthetic polynucleotide
gttatcattaaggtatctatgtatataagggggaataattgtaattcgagaaccg

SEQ ID NO: 2800 - DNA, 55 bp, Artificial Sequence
  Synthetic polynucleotide
tatattgtgagctcatccgtaatttaaaggaggtatagtgaattttgtgattcat

SEQ ID NO: 2801 - DNA, 55 bp, Artificial Sequence
  Synthetic polynucleotide
ttcttgtagaatcacactacagtataacgaggggtgcatatatttttatcttagt

SEQ ID NO: 2802 - DNA, 55 bp, Artificial Sequence
  Synthetic polynucleotide
gactttgttatagaatctaagtattcacactggagaaatgtaagttttgcgaagt

SEQ ID NO: 2803 - DNA, 55 bp, Artificial Sequence
  Synthetic polynucleotide
gcaagatggagaaatccagtaagataacggtgggttttcgaaattttataaaaaa

SEQ ID NO: 2804 - DNA, 55 bp, Artificial Sequence
  Synthetic polynucleotide
agaaccaaacaatgttcatgcttcatatttgggtggagaacactgcctataaatt

SEQ ID NO: 2805 - DNA, 55 bp, Artificial Sequence
  Synthetic polynucleotide
tagcttgaacacagcgcaagccactaattttggattagtaccatatccaccattt

SEQ ID NO: 2806 - DNA, 55 bp, Artificial Sequence
  Synthetic polynucleotide
ctatctccaaattgaccggttctctaatttaggtcggcttcattagaaggtttta

SEQ ID NO: 2807 - DNA, 55 bp, Artificial Sequence
  Synthetic polynucleotide
aattgagcaaacctgtcgcagacctataaatggaaatcgcttgtagcaaatatgg

SEQ ID NO: 2808 - DNA, 55 bp, Artificial Sequence
  Synthetic polynucleotide
taaagtgtcttttctcccaaatacttataatggggcaccgctctgaaaaaaaatt

SEQ ID NO: 2809 - DNA, 55 bp, Artificial Sequence
  Synthetic polynucleotide
agcagactgttataggcaagatccctttacgggaattactgaatacatccaattg

SEQ ID NO: 2810 - DNA, 55 bp, Artificial Sequence
  Synthetic polynucleotide
acgagcaaatttggtcctagcttacaatcgaggatggaatttagaatcgattaac

SEQ ID NO: 2811 - DNA, 55 bp, Artificial Sequence
  Synthetic polynucleotide
ctagcttagaaagaaaccagaccctttatggggaaaactatgctagacagtatca

SEQ ID NO: 2812 - DNA, 55 bp, Artificial Sequence
  Synthetic polynucleotide
aattgtccgaaaccaactaaatacttcatatggaataggctccccccaataactt

SEQ ID NO: 2813 - DNA, 55 bp, Artificial Sequence
  Synthetic polynucleotide
tttgatattccagtctcgagagaaccaatatgggaattagcttagttgcgtagag

SEQ ID NO: 2814 - DNA, 55 bp, Artificial Sequence
  Synthetic polynucleotide
gaaatttgagatagaacccctgatgctaatcggttggcatttcaatcgtattcct

SEQ ID NO: 2815 - DNA, 55 bp, Artificial Sequence
  Synthetic polynucleotide
gaggtcataagtctgccacataaatacactaggttctgattcccaatgactcttt

SEQ ID NO: 2816 - DNA, 55 bp, Artificial Sequence
  Synthetic polynucleotide
tttggtgtagtggatccattaattctccgtggggcagatatatatgtatatacag

SEQ ID NO: 2817 - DNA, 55 bp, Artificial Sequence
  Synthetic polynucleotide
actatacattaaaccacaagtgaccaacttcggctacatggcgaacattgttaca

SEQ ID NO: 2818 - DNA, 55 bp, Artificial Sequence
  Synthetic polynucleotide
ttacatgaccaacagccaaatttacacataaggagcttcatctataatcggccta

SEQ ID NO: 2819 - DNA, 55 bp, Artificial Sequence
  Synthetic polynucleotide
caaagcgctgttaaggcacttgcctaaattagggttgaatcgttagaatctgtag

SEQ ID NO: 2820 - DNA, 55 bp, Artificial Sequence
  Synthetic polynucleotide
tttctgtttcggaagacatcttaataattgagggtgagaggcaaccaaccaaggt

SEQ ID NO: 2821 - DNA, 55 bp, Artificial Sequence
  Synthetic polynucleotide
ttattataactgtgcccggtttcgtatattaggcaggagtacttgctgaaacagg

SEQ ID NO: 2822 - DNA, 55 bp, Artificial Sequence
  Synthetic polynucleotide
cctgagttattttgaccagctcgcttaatgggggaatagtttgcctgatttgtgg

SEQ ID NO: 2823 - DNA, 55 bp, Artificial Sequence
  Synthetic polynucleotide
cttaaccactggtgtacgacgaaaatttagtgggacagcaggatttcaacccaag

SEQ ID NO: 2824 - DNA, 55 bp, Artificial Sequence
  Synthetic polynucleotide
ctttcgtaagggtaacctcaaatctatttgggggagatagcctgaaactgtccag

SEQ ID NO: 2825 - DNA, 55 bp, Artificial Sequence
  Synthetic polynucleotide
aattctagtcgcattcctatttagaagcaacggcggatttctttcttggtggcat

SEQ ID NO: 2826 - DNA, 55 bp, Artificial Sequence
  Synthetic polynucleotide
cgcaatttcataggtgcctgaactatagtttggcgggttgtagttgtaaaccggt

SEQ ID NO: 2827 - DNA, 55 bp, Artificial Sequence
  Synthetic polynucleotide
gcaagacaatttctctcatcccgcttggtaaggacaaaccccagaattatcggaa

SEQ ID NO: 2828 - DNA, 55 bp, Artificial Sequence
  Synthetic polynucleotide
atatttgcatgctgaccgattgtatatagaaggcatggactagcgctgactccct

SEQ ID NO: 2829 - DNA, 55 bp, Artificial Sequence
  Synthetic polynucleotide
ctcctagtcgtaaatcctcagaaatatggctgggttaaaagtccctaatatggcg

SEQ ID NO: 2830 - DNA, 55 bp, Artificial Sequence
  Synthetic polynucleotide
agagatcaatactaacctcctaaacgacagggggtaaagctgagtctctatggtc

SEQ ID NO: 2831 - DNA, 55 bp, Artificial Sequence
  Synthetic polynucleotide
ataccgtggattaagtctacaagcacacggaggtctgttgatcgttggtatatat

SEQ ID NO: 2832 - DNA, 55 bp, Artificial Sequence
  Synthetic polynucleotide
tacaatgacgctgcgacatgtgtatgtcaaagggtttattgggcgatctgttatt

SEQ ID NO: 2833 - DNA, 55 bp, Artificial Sequence
  Synthetic polynucleotide
ttcaatcgaagtatagctatcttgctacggggggattgaagagaagaagaggagc

SEQ ID NO: 2834 - DNA, 55 bp, Artificial Sequence
  Synthetic polynucleotide
cgatcctcccccgcttcgatctgatattaacggggcctaggtcaaaagggaattc

SEQ ID NO: 2835 - DNA, 55 bp, Artificial Sequence
  Synthetic polynucleotide
cgcatatgttccaagcctgttatctattacaggtgctcaagtgaccgccccggat

SEQ ID NO: 2836 - DNA, 55 bp, Artificial Sequence
  Synthetic polynucleotide
ttaattgagattctacctttcagctaattgggggtattccgcactggcaccctcg

SEQ ID NO: 2837 - DNA, 55 bp, Artificial Sequence
  Synthetic polynucleotide
gatccgggtcaggccactcaagacaatttgcggtatcctacgttggtttttcgca

SEQ ID NO: 2838 - DNA, 55 bp, Artificial Sequence
  Synthetic polynucleotide
ccggtttaaattcgaccgttgcacacaaaatggggagagacaaatgccccagttt

SEQ ID NO: 2839 - DNA, 55 bp, Artificial Sequence
  Synthetic polynucleotide
cagggagcaaaaacgacccgcctcatttacaggtgaacaggcagtacgttcccgc

SEQ ID NO: 2840 - DNA, 55 bp, Artificial Sequence
  Synthetic polynucleotide
gttcagacactagaatcccgtcctttagcatgggtgtgtagcccatgcgtcttct

SEQ ID NO: 2841 - DNA, 55 bp, Artificial Sequence
  Synthetic polynucleotide
gttacttcgaccgcggccctttcccccttatgggttcacttcgcagacaaatcaa

SEQ ID NO: 2842 - DNA, 55 bp, Artificial Sequence
  Synthetic polynucleotide
catgcgaggtcccatcccgtgatgatcctaagggcgaaaggtgcgccactataaa

SEQ ID NO: 2843 - DNA, 55 bp, Artificial Sequence
  Synthetic polynucleotide
agcatcgacctccgttcgagaaataccctctggcttgggcagggacggaatcgcg

SEQ ID NO: 2844 - DNA, 55 bp, Artificial Sequence
  Synthetic polynucleotide
acatcgggggaccattcactaaacctcgtaaggaaggatctgtgggtcactgcgt

SEQ ID NO: 2845 - DNA, 55 bp, Artificial Sequence
  Synthetic polynucleotide
tggccgtctccagtaccctgaaaaatctggcggctactgggttgggctacccaga

SEQ ID NO: 2846 - DNA, 55 bp, Artificial Sequence
  Synthetic polynucleotide
cctggagaatccggcgcatcacataactgagggtgtttccatgcatttactgaag

SEQ ID NO: 2847 - DNA, 55 bp, Artificial Sequence
  Synthetic polynucleotide
cgtggatattaacctccctgtgataccggcagggtaatgctcagaggtttgatat

SEQ ID NO: 2848 - DNA, 55 bp, Artificial Sequence
  Synthetic polynucleotide
gtcggggctcaacgccctaccgtacagagatggatataggcttaggtcaagtgtt

SEQ ID NO: 2849 - DNA, 55 bp, Artificial Sequence
  Synthetic polynucleotide
gactcctttcgcccatccgctccctcgtttggggacacacgggctatgtggactg

SEQ ID NO: 2850 - DNA, 55 bp, Artificial Sequence
  Synthetic polynucleotide
ggcgagccggccctaccgcaccgactttcaggggtgtagtggctcctgcactgag

SEQ ID NO: 2851 - DNA, 55 bp, Artificial Sequence
  Synthetic polynucleotide
acgaccgccctctctccacccgcagtcttttgggggcgctcgttatgcggccaac

SEQ ID NO: 2852 - DNA, 55 bp, Artificial Sequence
  Synthetic polynucleotide
cctcacgtacgacagtcaccgcaaaaatagggggcggcgcgtgaactggcagcca

SEQ ID NO: 2853 - DNA, 55 bp, Artificial Sequence
  Synthetic polynucleotide
gtcacccccgacagccctcgaagtgaatttggggtctcgatgccactccacacgg

SEQ ID NO: 2854 - DNA, 55 bp, Artificial Sequence
  Synthetic polynucleotide
ggcggcaccggaccgcctcaagcctttaaatggcatggacaccgcacgtcgggta

SEQ ID NO: 2855 - DNA, 55 bp, Artificial Sequence
  Synthetic polynucleotide
caagcgagagctcagccgagtagtcactaatggaaaaagcgcggcggcgctccgg

SEQ ID NO: 2856 - DNA, 55 bp, Artificial Sequence
  Synthetic polynucleotide
gtgcccaacggcccgtcccatccgccagtgaggtggtaaccgactttggtagtga

SEQ ID NO: 2857 - DNA, 55 bp, Artificial Sequence
  Synthetic polynucleotide
gccgggcgagctgatgctttgaaattaccgcggtgcgtccctagggccagaactc

SEQ ID NO: 2858 - DNA, 55 bp, Artificial Sequence
  Synthetic polynucleotide
ccgcgcctatggcgagctcgagacgagaaatggttactcaacccataccccgccc

SEQ ID NO: 2859 - DNA, 55 bp, Artificial Sequence
  Synthetic polynucleotide
cacgcggactaactacccacgacccccctaaggtggaacgctttgctgcactccg

SEQ ID NO: 2860 - DNA, 55 bp, Artificial Sequence
  Synthetic polynucleotide
gtcaacgggccccagacctaacacttaggcgggagcggagagctggctatctggt

SEQ ID NO: 2861 - DNA, 55 bp, Artificial Sequence
  Synthetic polynucleotide
aatcccactgcgtccacagtagaaacaggggggcgggacgttccgtgagtcgcct

SEQ ID NO: 2862 - DNA, 55 bp, Artificial Sequence
  Synthetic polynucleotide
ggcggttggagtcctgcgatacaccactggggggatgtggtcgactgacgcagac

SEQ ID NO: 2863 - DNA, 55 bp, Artificial Sequence
  Synthetic polynucleotide
gagggcgacagccctgctcagaattacggtgggtaagagttccccccgtcgcgca

SEQ ID NO: 2864 - DNA, 55 bp, Artificial Sequence
  Synthetic polynucleotide
tcttgaactaatagctctatttgtctttcttggtagttaacagactaaatgaaat

SEQ ID NO: 2865 - DNA, 55 bp, Artificial Sequence
  Synthetic polynucleotide
gacgctaaaattaaatctattacttagttagggtcacctagatttttgatcaagg

SEQ ID NO: 2866 - DNA, 55 bp, Artificial Sequence
  Synthetic polynucleotide
tgggactaactttatactttaggcattaaacggcatctaatgatttatttagtag

SEQ ID NO: 2867 - DNA, 55 bp, Artificial Sequence
  Synthetic polynucleotide
gtataaaaaccttagacgtgtggacattactggacttgtttactttatgattaac

SEQ ID NO: 2868 - DNA, 55 bp, Artificial Sequence
  Synthetic polynucleotide
tgtaatctcgatttagccgtactttagtttaggttctatcgcattaaataaaaga

SEQ ID NO: 2869 - DNA, 55 bp, Artificial Sequence
  Synthetic polynucleotide
aattggcctttctctacacgaaattggtttgggttatatataattattagcaatc

SEQ ID NO: 2870 - DNA, 55 bp, Artificial Sequence
  Synthetic polynucleotide
catctctgcttggtgtcaatgaaatagaataggtcacatacaaatttgaacaatt

SEQ ID NO: 2871 - DNA, 55 bp, Artificial Sequence
  Synthetic polynucleotide
atctttacagccaatactcgggtttaagtttggtttatgcgaattttaacatact

SEQ ID NO: 2872 - DNA, 55 bp, Artificial Sequence
  Synthetic polynucleotide
taactgtccgtatttcccttcatatctatctggataatgtttatctataccgaaa

SEQ ID NO: 2873 - DNA, 55 bp, Artificial Sequence
  Synthetic polynucleotide
ttttctaaatgatatgcgaagaagaatagaaggtattgtttcgtgcgtgaagttt

SEQ ID NO: 2874 - DNA, 55 bp, Artificial Sequence
  Synthetic polynucleotide
gaaattcacataaacacaactcaccgtccgtggcaatttatgtgtttaaaataaa

SEQ ID NO: 2875 - DNA, 55 bp, Artificial Sequence
  Synthetic polynucleotide
gaaagaataaaaaaaccacaggaagttgacaggtagactagaaatctataatgat

SEQ ID NO: 2876 - DNA, 55 bp, Artificial Sequence
  Synthetic polynucleotide
tacattgaaatatcaacataaccagaacagaggcaattttcacttacaataagtc

SEQ ID NO: 2877 - DNA, 55 bp, Artificial Sequence
  Synthetic polynucleotide
tatgtattgagacgtgcattggaaaaccattggagattgcttttgttattatgat

SEQ ID NO: 2878 - DNA, 55 bp, Artificial Sequence
  Synthetic polynucleotide
tcacatgattacttacctaaagagaacgaacggatatgtcttttaacaattgtat

SEQ ID NO: 2879 - DNA, 55 bp, Artificial Sequence
  Synthetic polynucleotide
gatagtgagcttaaatcacctggagtttcatggagaaaccctttgccgtttatta

SEQ ID NO: 2880 - DNA, 55 bp, Artificial Sequence
  Synthetic polynucleotide
ggtacagtgcgtaattcaagtggctaaaaagggctaagttttcaaatcactacaa

SEQ ID NO: 2881 - DNA, 55 bp, Artificial Sequence
  Synthetic polynucleotide
tactgttaatcccagtccaattggataattgggtcgtttgaaacaaattggcgtg

SEQ ID NO: 2882 - DNA, 55 bp, Artificial Sequence
  Synthetic polynucleotide
atacaggttttaaaaacgttatgatagtttaggataggtgccccagtaagcgtcc

SEQ ID NO: 2883 - DNA, 55 bp, Artificial Sequence
  Synthetic polynucleotide
atcttcaaaaacctcccctgtcggcttaattggctaaccattcttttctataaag

SEQ ID NO: 2884 - DNA, 55 bp, Artificial Sequence
  Synthetic polynucleotide
tcctcaaatctacgcccataacgaatataacggatagacaatgttgcacctacat

SEQ ID NO: 2885 - DNA, 55 bp, Artificial Sequence
  Synthetic polynucleotide
aaaaacttatagttcacgtaactggagatttggagcgtggaaaccatctctccaa

SEQ ID NO: 2886 - DNA, 55 bp, Artificial Sequence
  Synthetic polynucleotide
aagaccaactaaagatccgggataggagttaggatgttgcataatttcatagtta

SEQ ID NO: 2887 - DNA, 55 bp, Artificial Sequence
  Synthetic polynucleotide
gtcaaagtccattattcgaaatccaatccaaggtcactggaatttgttgattaag

SEQ ID NO: 2888 - DNA, 55 bp, Artificial Sequence
  Synthetic polynucleotide
cgtaccctaacggtttcaaattgactgcactggtcttgctaaatgttaaatgatc

SEQ ID NO: 2889 - DNA, 55 bp, Artificial Sequence
  Synthetic polynucleotide
taacaaagacatttaccaaaactcggtatccggtggaggcattctcctagttttt

SEQ ID NO: 2890 - DNA, 55 bp, Artificial Sequence
  Synthetic polynucleotide
tttcaaactcggaagtcctacggtcaacagtggtcaatacgttcatttagttctt

SEQ ID NO: 2891 - DNA, 55 bp, Artificial Sequence
  Synthetic polynucleotide
ttgaattcattaggaacaagaatacggaacgggcttattttatacaagatcgatc

SEQ ID NO: 2892 - DNA, 55 bp, Artificial Sequence
  Synthetic polynucleotide
ggtaatttaagaatgtctactgtaccaggctggaccaaataacatcaggatatcg

SEQ ID NO: 2893 - DNA, 55 bp, Artificial Sequence
  Synthetic polynucleotide
tttttttatgagttcacgaggataaaaccgagggggtgatcctgcttctcaattt

SEQ ID NO: 2894 - DNA, 55 bp, Artificial Sequence
  Synthetic polynucleotide
catggcggttagttgtctgcaagctaaatttggagctaatacacctccataggaa

SEQ ID NO: 2895 - DNA, 55 bp, Artificial Sequence
  Synthetic polynucleotide
tccggattgtcattccccttcggttatttgcggttaaggtttggcaataaataga

SEQ ID NO: 2896 - DNA, 55 bp, Artificial Sequence
  Synthetic polynucleotide
tagctaaaggaatttgcccctaggctttctagggaaagtgtctactaagtcactt

SEQ ID NO: 2897 - DNA, 55 bp, Artificial Sequence
  Synthetic polynucleotide
ctcgattacgtgactcctcttacggtaaaacggtaggtttaaggctccgtatcat

SEQ ID NO: 2898 - DNA, 55 bp, Artificial Sequence
  Synthetic polynucleotide
ctcaaagatgtccgagcaagtcggtttacacggttgttccaaccatagttacttg

SEQ ID NO: 2899 - DNA, 55 bp, Artificial Sequence
  Synthetic polynucleotide
gagcacgctgattagtcgcctaaggatttaaggtgtagatagttaacactatcac

SEQ ID NO: 2900 - DNA, 55 bp, Artificial Sequence
  Synthetic polynucleotide
atctatttgggtcccactcctacgattgattggatcgattgcggctggaattaat

SEQ ID NO: 2901 - DNA, 55 bp, Artificial Sequence
  Synthetic polynucleotide
cttaaaaattgagctccttcattaaggtaaaggcaggccgttatccgctcggtaa

SEQ ID NO: 2902 - DNA, 55 bp, Artificial Sequence
  Synthetic polynucleotide
aaaatgcgtcactgtactgataatggtaaatggacgatgctctactctggcagat

SEQ ID NO: 2903 - DNA, 55 bp, Artificial Sequence
  Synthetic polynucleotide
gtttcaaaaaattgatccttcaagagagagaggcgatgcccggctctttgtctgt

SEQ ID NO: 2904 - DNA, 55 bp, Artificial Sequence
  Synthetic polynucleotide
cacgtactggaagtccccatgtatgttgtatggctatatgcaccacacattgaag

SEQ ID NO: 2905 - DNA, 55 bp, Artificial Sequence
  Synthetic polynucleotide
gccattaacatagcatccatggttgtcgtcaggaagccacaattagcatcactca

SEQ ID NO: 2906 - DNA, 55 bp, Artificial Sequence
  Synthetic polynucleotide
ttttagaaggatactcccatagagcatagcaggcgaagtgtagtggaatatggtc

SEQ ID NO: 2907 - DNA, 55 bp, Artificial Sequence
  Synthetic polynucleotide
tcacatatctcttaaccaaagaatgacgactggaaggcagccgcagatatccagt

SEQ ID NO: 2908 - DNA, 55 bp, Artificial Sequence
  Synthetic polynucleotide
tttctcaaatgagaaacgtacgaacaagtacggaatatggagcgcaacgcgatgc

SEQ ID NO: 2909 - DNA, 55 bp, Artificial Sequence
  Synthetic polynucleotide
gcggccttagtctttacgtagcgggtttatagggtgttgcctagaattgtaagcg

SEQ ID NO: 2910 - DNA, 55 bp, Artificial Sequence
  Synthetic polynucleotide
tattatgctccgctgccaccacggctttattgggcttcagaactaaccgatgcag

SEQ ID NO: 2911 - DNA, 55 bp, Artificial Sequence
  Synthetic polynucleotide
cgtagaaaatccactccgtgtggactttaccggttggactaggatgcccccagaa

SEQ ID NO: 2912 - DNA, 55 bp, Artificial Sequence
  Synthetic polynucleotide
gcctttgctgattgatcataccttggtgcttggcataagactcgtgtttgagagg

SEQ ID NO: 2913 - DNA, 55 bp, Artificial Sequence
  Synthetic polynucleotide
aatccttagcccttgccgcgctatgcgatgcggttttttcaaggggcattaatcg

SEQ ID NO: 2914 - DNA, 55 bp, Artificial Sequence
  Synthetic polynucleotide
agcagctatgcttagccattactgggtcctgggaaatcgtacacatgcacatcgc

SEQ ID NO: 2915 - DNA, 55 bp, Artificial Sequence
  Synthetic polynucleotide
accatactcgtatctccggatgcaagagcaaggggcagtgtctaatatcctctaa

SEQ ID NO: 2916 - DNA, 55 bp, Artificial Sequence
  Synthetic polynucleotide
taaccgcgcttaatacctcacgagataaaacgggagatagcttgatcggttccgt

SEQ ID NO: 2917 - DNA, 55 bp, Artificial Sequence
  Synthetic polynucleotide
aatgttggaatttcgtcgttctacggtccacggcactgtgcaaatccatgcgtgt

SEQ ID NO: 2918 - DNA, 55 bp, Artificial Sequence
  Synthetic polynucleotide
ggctgaagcaacatccccagttagtcagtcaggtcgcggctgctcacgcgcatag

SEQ ID NO: 2919 - DNA, 55 bp, Artificial Sequence
  Synthetic polynucleotide
cccgcgtataattaatccccgagccatcgagggataaggtattgacgcatgatca

SEQ ID NO: 2920 - DNA, 55 bp, Artificial Sequence
  Synthetic polynucleotide
gagcccgtatgctgtgcccatcctaggaggaggaagatacaactgctgtcggttc

SEQ ID NO: 2921 - DNA, 55 bp, Artificial Sequence
  Synthetic polynucleotide
ttaactctgtcacgatcctctgagcacagcaggtgctttgatgccagttttctcg

SEQ ID NO: 2922 - DNA, 55 bp, Artificial Sequence
  Synthetic polynucleotide
attgagttgccaatcccgatagacgaaagacggctggctagatcacttgggcagg

SEQ ID NO: 2923 - DNA, 55 bp, Artificial Sequence
  Synthetic polynucleotide
ttatccgaggaattaccggcttataaccggcggcaaacgggagagtgcccatacc

SEQ ID NO: 2924 - DNA, 55 bp, Artificial Sequence
  Synthetic polynucleotide
tcttatgctgcctgtgcacgcccagttgcacgggggggatccgtgatgggaacct

SEQ ID NO: 2925 - DNA, 55 bp, Artificial Sequence
  Synthetic polynucleotide
acgcgcactccatgaacttgtccgatttccgggtgcgcgcgtcgggccttggggg

SEQ ID NO: 2926 - DNA, 55 bp, Artificial Sequence
  Synthetic polynucleotide
cggcggctcccgttgccgccccggaatttgaggaattcatgcgatagcgcccaag

SEQ ID NO: 2927 - DNA, 55 bp, Artificial Sequence
  Synthetic polynucleotide
cgggagccctgccacgcgaagtcagctgcttggtgattggaccgggacgacccgc

SEQ ID NO: 2928 - DNA, 55 bp, Artificial Sequence
  Synthetic polynucleotide
cgaccccgccggttgacgccctaggtcactaggaagcacgtagcctaccgcgaat

SEQ ID NO: 2929 - DNA, 55 bp, Artificial Sequence
  Synthetic polynucleotide
accccggcctccacaccactggggaagtattgggaatctgtgctcaacgccggct

SEQ ID NO: 2930 - DNA, 55 bp, Artificial Sequence
  Synthetic polynucleotide
catcgaaccttctcgcccttgcgagttcgaggggtcagggacgaccaggcgtacc

SEQ ID NO: 2931 - DNA, 55 bp, Artificial Sequence
  Synthetic polynucleotide
gggctccggtcgagcgcgcaaccgctcctctggggaggatttaacggcagtgagg

SEQ ID NO: 2932 - DNA, 55 bp, Artificial Sequence
  Synthetic polynucleotide
gagtccctccagccaacccacagcgtaaagcggtatcttagggccggtggtgcca

SEQ ID NO: 2933 - DNA, 55 bp, Artificial Sequence
  Synthetic polynucleotide
gcggaagcgagtcctacctccagatgggaatggttacccgcgcacggcttggaca

SEQ ID NO: 2934 - DNA, 55 bp, Artificial Sequence
  Synthetic polynucleotide
gacgttcccctgcgcacttgtcagatccagagggactcgccgagcgcgacactcg

SEQ ID NO: 2935 - DNA, 55 bp, Artificial Sequence
  Synthetic polynucleotide
tatggcattgagagccctaggaacaccctagggtcatatcgcgcccccgacgggg

SEQ ID NO: 2936 - DNA, 55 bp, Artificial Sequence
  Synthetic polynucleotide
cagtcgggtgggctcacacacattccgtgccggtagtgcggttgagagcatggca

SEQ ID NO: 2937 - DNA, 55 bp, Artificial Sequence
  Synthetic polynucleotide
cctctcatccgtaacgccttaccgctgtgggggctgtattgcggtcgtacgccca

SEQ ID NO: 2938 - DNA, 55 bp, Artificial Sequence
  Synthetic polynucleotide
cgcgatgccccatcatcttctcgtccgggccgggaaaggaagctatgaggtggcc

SEQ ID NO: 2939 - DNA, 55 bp, Artificial Sequence
  Synthetic polynucleotide
tacgatttatatcaaccattaaactcttcttggctctaaactaaatagcagtacg

SEQ ID NO: 2940 - DNA, 55 bp, Artificial Sequence
  Synthetic polynucleotide
actatgcaactcttccctttgtgataaatgtggctgtattgatataatacattag

SEQ ID NO: 2941 - DNA, 55 bp, Artificial Sequence
  Synthetic polynucleotide
tgataacaaatcttaccatggcatttaatatggaatttcaaatttggcatgctat

SEQ ID NO: 2942 - DNA, 55 bp, Artificial Sequence
  Synthetic polynucleotide
tataggctaaaatttacaactatgggatattgggcatcgacttttattgtaagct

SEQ ID NO: 2943 - DNA, 55 bp, Artificial Sequence
  Synthetic polynucleotide
tcctctaaggatataccagatttggagattcggataaaaatttagattaatttac

SEQ ID NO: 2944 - DNA, 55 bp, Artificial Sequence
  Synthetic polynucleotide
ttgtaaaaatataatacgcggttatggttaagggcacgagtataattttaaaatg

SEQ ID NO: 2945 - DNA, 55 bp, Artificial Sequence
  Synthetic polynucleotide
tattatattacgctagcatcatatggataaaggatcgcaatgatgatacactgta

SEQ ID NO: 2946 - DNA, 55 bp, Artificial Sequence
  Synthetic polynucleotide
ttaaagcctattggttccaagatattacctagggggatattaacatgtatttaac

SEQ ID NO: 2947 - DNA, 55 bp, Artificial Sequence
  Synthetic polynucleotide
attaactcaataagtacctatattaggttcagggggtggatttcaagaaagtaaa

SEQ ID NO: 2948 - DNA, 55 bp, Artificial Sequence
  Synthetic polynucleotide
ccaacaaaagtatcgtcgaattagagcaagaggtttgtaataaattcacgaaata

SEQ ID NO: 2949 - DNA, 55 bp, Artificial Sequence
  Synthetic polynucleotide
gacaaatagaacgatacataggtatcaagttggtatagatccatttaattgtcta

SEQ ID NO: 2950 - DNA, 55 bp, Artificial Sequence
  Synthetic polynucleotide
tcctaaatcgagtgaactagatacttcattcggtttgtcatagataaatttcgaa

SEQ ID NO: 2951 - DNA, 55 bp, Artificial Sequence
  Synthetic polynucleotide
aatatcaaattatcaccggagttaaagtggaggatataaagcaaatgtgaattga

SEQ ID NO: 2952 - DNA, 55 bp, Artificial Sequence
  Synthetic polynucleotide
ttaaatttggatatggcaggatgcaccagcaggtcaacttaattattaattattg

SEQ ID NO: 2953 - DNA, 55 bp, Artificial Sequence
  Synthetic polynucleotide
tttattaatgtgactacttgtgaatcatgatggagaatcaatttagctctttgct

SEQ ID NO: 2954 - DNA, 55 bp, Artificial Sequence
  Synthetic polynucleotide
agtttttgaacatatgctcttgtgctttcttggacatgcgattaccatattctgc

SEQ ID NO: 2955 - DNA, 55 bp, Artificial Sequence
  Synthetic polynucleotide
gtatacatattcttccctggctatggttcttgggtttaactaaaccgaatctata

SEQ ID NO: 2956 - DNA, 55 bp, Artificial Sequence
  Synthetic polynucleotide
aaaggactttgatatacgtcttccatttcctgggtattccaggacagcaatataa

SEQ ID NO: 2957 - DNA, 55 bp, Artificial Sequence
  Synthetic polynucleotide
ctattagggataaaagctttcgatttatttcgggttttaggtcgtgactgtatgt

SEQ ID NO: 2958 - DNA, 55 bp, Artificial Sequence
  Synthetic polynucleotide
gttactgtctatggatccgtttaggtatataggagtaaattgtgacaaagcttaa

SEQ ID NO: 2959 - DNA, 55 bp, Artificial Sequence
  Synthetic polynucleotide
aaggatatacaaaagtctggtttgtcatcagggtattcaacagtctcgaactaca

SEQ ID NO: 2960 - DNA, 55 bp, Artificial Sequence
  Synthetic polynucleotide
cttacttcttacatgtcccagacgtataccaggtttgacgcatacatgaacttaa

SEQ ID NO: 2961 - DNA, 55 bp, Artificial Sequence
  Synthetic polynucleotide
atccgctttcaagcttcagctagagttagtaggaataaaaaaggcagcttctagt

SEQ ID NO: 2962 - DNA, 55 bp, Artificial Sequence
  Synthetic polynucleotide
aaatgaggctaatatacaatcagttagataggggtttggcaaagatgccaacgtc

SEQ ID NO: 2963 - DNA, 55 bp, Artificial Sequence
  Synthetic polynucleotide
agtctatacattcacgctaaaacagacctctggtagacacaaggagttaaatacg

SEQ ID NO: 2964 - DNA, 55 bp, Artificial Sequence
  Synthetic polynucleotide
atgtcacctattaggtcaacagctgtcctatggtcgttatatgaacaataagact

SEQ ID NO: 2965 - DNA, 55 bp, Artificial Sequence
  Synthetic polynucleotide
gccaaacttatcaaacccaaagattgttgtgggccctttttcagtaagtttctca

SEQ ID NO: 2966 - DNA, 55 bp, Artificial Sequence
  Synthetic polynucleotide
ctatgaccattatggcccgtatggcaaggctggtaatcagtcattttaacattaa

SEQ ID NO: 2967 - DNA, 55 bp, Artificial Sequence
  Synthetic polynucleotide
tatattcgatatccaacggtaactaaccacaggcggtaactttctatggatgatt

SEQ ID NO: 2968 - DNA, 55 bp, Artificial Sequence
  Synthetic polynucleotide
catattcgatgatcaccttcagagtgtcagtggagctgactataagaaaacaaac

SEQ ID NO: 2969 - DNA, 55 bp, Artificial Sequence
  Synthetic polynucleotide
aaaatgctattacaatcgccctactcttcttgggatagccgagtgcaaaactgtt

SEQ ID NO: 2970 - DNA, 55 bp, Artificial Sequence
  Synthetic polynucleotide
cgtggctcttacatcgcagcggtctaatttaggtcagggagagtttaaacaatac

SEQ ID NO: 2971 - DNA, 55 bp, Artificial Sequence
  Synthetic polynucleotide
tcaactctccttcgtgcacttaggtatttcaggtccgtcgcccaacttaattagt

SEQ ID NO: 2972 - DNA, 55 bp, Artificial Sequence
  Synthetic polynucleotide
tgcacttaccgtatctcgtagagatttaagaggtcgaggcgaaaactaagtcaga

SEQ ID NO: 2973 - DNA, 55 bp, Artificial Sequence
  Synthetic polynucleotide
cgtcttaaaaccgcctcaattacctggtcttggatatcacttgtactcgcaaacc

SEQ ID NO: 2974 - DNA, 55 bp, Artificial Sequence
  Synthetic polynucleotide
tctacgagatggacgcccgagtttggtttagggtacaatttactggttaaacgta

SEQ ID NO: 2975 - DNA, 55 bp, Artificial Sequence
  Synthetic polynucleotide
atcttacttaccttcgcttaacccggtgcctgggatcgatgacaataaactgtga

SEQ ID NO: 2976 - DNA, 55 bp, Artificial Sequence
  Synthetic polynucleotide
gtgttaagctgagttccttcagctctatcagggaaatatcgagttcacctaattc

SEQ ID NO: 2977 - DNA, 55 bp, Artificial Sequence
  Synthetic polynucleotide
ttatacgctttcatgccatgcgtaatcatccggcaatataggattatccgtccaa

SEQ ID NO: 2978 - DNA, 55 bp, Artificial Sequence
  Synthetic polynucleotide
attcagctttccgctgcaagataggaacgtcggaagattattactaatacgcacc

SEQ ID NO: 2979 - DNA, 55 bp, Artificial Sequence
  Synthetic polynucleotide
agaccgagagtcagagcgaacatagacgataggtaaacaaatcactagtctgagc

SEQ ID NO: 2980 - DNA, 55 bp, Artificial Sequence
  Synthetic polynucleotide
actgacatatggtcatcgtgatacacagcacggttagctaggtcgtatcgttaac

SEQ ID NO: 2981 - DNA, 55 bp, Artificial Sequence
  Synthetic polynucleotide
gcgaaacttagacccacattaccttacgtacggattcactagctatagtcacttt

SEQ ID NO: 2982 - DNA, 55 bp, Artificial Sequence
  Synthetic polynucleotide
agaaggcaaagaccaacggataacatgagatggtttttccatacgttaagtcggc

SEQ ID NO: 2983 - DNA, 55 bp, Artificial Sequence
  Synthetic polynucleotide
ctcaaccaattctccccaggaaagatcaggaggaattctgttggaacttagcatc

SEQ ID NO: 2984 - DNA, 55 bp, Artificial Sequence
  Synthetic polynucleotide
atgctaacaggtgcctccggcttattattatggcatcatcccgtttggttgtggt

SEQ ID NO: 2985 - DNA, 55 bp, Artificial Sequence
  Synthetic polynucleotide
acaagaaaaatcccagctccgtcttcttctaggtcgtgcggcaccaaaccggtat

SEQ ID NO: 2986 - DNA, 55 bp, Artificial Sequence
  Synthetic polynucleotide
aagtaacacgtctcatctccgtggctttaacgggcctacatcagcggtaagtcac

SEQ ID NO: 2987 - DNA, 55 bp, Artificial Sequence
  Synthetic polynucleotide
ggagtgaagaactcatcatccggttaaacggggcgggccttctttgcttggataa

SEQ ID NO: 2988 - DNA, 55 bp, Artificial Sequence
  Synthetic polynucleotide
gcagtaactcggtctccagttgtcttacttcggcccatgcatttgcccagaacga

SEQ ID NO: 2989 - DNA, 55 bp, Artificial Sequence
  Synthetic polynucleotide
atgcgtcggttaggaccgcccagactatctaggggttgtccggcatggaatgccc

SEQ ID NO: 2990 - DNA, 55 bp, Artificial Sequence
  Synthetic polynucleotide
atgtctctcggtcatgcgcattggaactatgggagctcggactatgttgcaagtg

SEQ ID NO: 2991 - DNA, 55 bp, Artificial Sequence
  Synthetic polynucleotide
ggtgggcactgacatccaaagtttgcgtccgggaattatgactcattccggatgt

SEQ ID NO: 2992 - DNA, 55 bp, Artificial Sequence
  Synthetic polynucleotide
aacacacggtcctggccctccggagatgtatggagcacaattggtatattgacgt

SEQ ID NO: 2993 - DNA, 55 bp, Artificial Sequence
  Synthetic polynucleotide
tgggccgtggagaccgccgttaagtgccatgggaagtggatatcctgacatacat

SEQ ID NO: 2994 - DNA, 55 bp, Artificial Sequence
  Synthetic polynucleotide
ggcccaagtcttgcgccctaatacgaccctaggaggataggggcagtggtgtggt

SEQ ID NO: 2995 - DNA, 55 bp, Artificial Sequence
  Synthetic polynucleotide
ccgactcggccatctccgcctccatggagctggagtgaagtcaagattaggtata

SEQ ID NO: 2996 - DNA, 55 bp, Artificial Sequence
  Synthetic polynucleotide
gattacatgatcctaccatctaagcgatggtggcggatcctacattgctgtatcc

SEQ ID NO: 2997 - DNA, 55 bp, Artificial Sequence
  Synthetic polynucleotide
gcagatacattaagcacctatcgaccccgagggaactacgcagctaatccacgaa

SEQ ID NO: 2998 - DNA, 55 bp, Artificial Sequence
  Synthetic polynucleotide
aactctatacgaatcgctgatctgcaacactggtaggcggggtgaacacataaac

SEQ ID NO: 2999 - DNA, 55 bp, Artificial Sequence
  Synthetic polynucleotide
gagggtcggtctatagcacccgggaattcagggtaaagtgctatgggccgggggc

SEQ ID NO: 3000 - DNA, 55 bp, Artificial Sequence
  Synthetic polynucleotide
tcccagctcagcttccccgtctgctgatctgggatgaatgtagcggcggtacgcc

SEQ ID NO: 3001 - DNA, 55 bp, Artificial Sequence
  Synthetic polynucleotide
cggcggctccgcggtccgactcttagttctaggagaaatacccacccgtggagca

SEQ ID NO: 3002 - DNA, 55 bp, Artificial Sequence
  Synthetic polynucleotide
tgtgctccccctatcgcaccctgttgaatgagggctgacggcgtcatcaggcccg

SEQ ID NO: 3003 - DNA, 55 bp, Artificial Sequence
  Synthetic polynucleotide
acttgcgactttagtcccccagggctttagaggcggtgaacgacgcgccggggac

SEQ ID NO: 3004 - DNA, 55 bp, Artificial Sequence
  Synthetic polynucleotide
gtacgtcgacggcgcccggacgagtcttactggtcaccagcatccggggggactg

SEQ ID NO: 3005 - DNA, 55 bp, Artificial Sequence
  Synthetic polynucleotide
gaccttgcccgcacccctcatcgctgctgcgggattcaatagagccacgggggag

SEQ ID NO: 3006 - DNA, 55 bp, Artificial Sequence
  Synthetic polynucleotide
atcgctgagcgtgtcgccggtctacattacaggcttccccctgggctcgtagcgc

SEQ ID NO: 3007 - DNA, 55 bp, Artificial Sequence
  Synthetic polynucleotide
cgtgcttccaggttgaccgcaatgccaaatgggtggggcgagtctcgcgccggat

SEQ ID NO: 3008 - DNA, 55 bp, Artificial Sequence
  Synthetic polynucleotide
gcgctggacgatcggccttccaaagacgaaaggccagtcgcgaagggttggccct

SEQ ID NO: 3009 - DNA, 55 bp, Artificial Sequence
  Synthetic polynucleotide
cgaaccagtccaacgtctcttaccatgcgcggggcatgccgggtctgccggaagc

SEQ ID NO: 3010 - DNA, 55 bp, Artificial Sequence
  Synthetic polynucleotide
acaggcgggttttgcacggtacaatggcataggctttcacttgcgcccggcgccc

SEQ ID NO: 3011 - DNA, 55 bp, Artificial Sequence
  Synthetic polynucleotide
gagaggacccattgctcgagaactgacatctggtggtccccgagctcccgtgccc

SEQ ID NO: 3012 - DNA, 55 bp, Artificial Sequence
  Synthetic polynucleotide
gtgggacccgccttctccccaacggacgtacggggagtgggtgtaatgagatccg

SEQ ID NO: 3013 - DNA, 55 bp, Artificial Sequence
  Synthetic polynucleotide
gccacacacggttccacctatcagacacagggggcgcataagcgatacgtgcggg

SEQ ID NO: 3014 - DNA, 55 bp, Artificial Sequence
  Synthetic polynucleotide
tatattacacactaaaccgttattgtttcgtggctttgtcaatgtgaaatttcaa

SEQ ID NO: 3015 - DNA, 55 bp, Artificial Sequence
  Synthetic polynucleotide
attgttctataattgtctttaatctattattggtaaatgacataacaactacgac

SEQ ID NO: 3016 - DNA, 55 bp, Artificial Sequence
  Synthetic polynucleotide
aaattagaacgcttggcgatgattaattatgggattattgtccatacttgaaaga

SEQ ID NO: 3017 - DNA, 55 bp, Artificial Sequence
  Synthetic polynucleotide
catcttactgagaaatcagttcacttaatctggactttaatatcgagtctaaatt

SEQ ID NO: 3018 - DNA, 55 bp, Artificial Sequence
  Synthetic polynucleotide
ttccttcagcaactttcataatccttatcttggagatctgtgcttaaataacata

SEQ ID NO: 3019 - DNA, 55 bp, Artificial Sequence
  Synthetic polynucleotide
attttcaaagaaatcgcatggcataaatatgggtcatcatctcatctcataatgt

SEQ ID NO: 3020 - DNA, 55 bp, Artificial Sequence
  Synthetic polynucleotide
aatttgtagataatagcaatgtatgaaaaatggtttcatatcggatagttaagtt

SEQ ID NO: 3021 - DNA, 55 bp, Artificial Sequence
  Synthetic polynucleotide
tgtattctagttataccttaaaaagtctcaaggtgaaaagaagatctcacactca

SEQ ID NO: 3022 - DNA, 55 bp, Artificial Sequence
  Synthetic polynucleotide
ttggcttgatcactatcaacaatgattaattggaacatgtagacacgtcaaattt

SEQ ID NO: 3023 - DNA, 55 bp, Artificial Sequence
  Synthetic polynucleotide
tttgttaccaattacacctgattgatttgttggtcgttttcagatgtatagtcta

SEQ ID NO: 3024 - DNA, 55 bp, Artificial Sequence
  Synthetic polynucleotide
aaaatttgttacacctcgaatgaatcgaattggaatagtgatagacctatttctc

SEQ ID NO: 3025 - DNA, 55 bp, Artificial Sequence
  Synthetic polynucleotide
ggtaactattttattgcggatattgatagaagggattgagatctttaccaattac

SEQ ID NO: 3026 - DNA, 55 bp, Artificial Sequence
  Synthetic polynucleotide
gtaaaatatattaccactaaacattgcagccggattaaaatttacatcgaatgtt

SEQ ID NO: 3027 - DNA, 55 bp, Artificial Sequence
  Synthetic polynucleotide
ttgatgataacatgttcaacaaaccgacaaaggatattagagggtataacaatgt

SEQ ID NO: 3028 - DNA, 55 bp, Artificial Sequence
  Synthetic polynucleotide
ataacaagagaaaagtcaaatgcaaacgagcggacgatttgtagtaagtaaaaat

SEQ ID NO: 3029 - DNA, 55 bp, Artificial Sequence
  Synthetic polynucleotide
aaatcctaggttgagtctgtcgatttatttcggataatacgagaaccatggagac

SEQ ID NO: 3030 - DNA, 55 bp, Artificial Sequence
  Synthetic polynucleotide
cataactcggagagccccacctgattatttaggccattagcgaaaaaataactta

SEQ ID NO: 3031 - DNA, 55 bp, Artificial Sequence
  Synthetic polynucleotide
attatatttgtggtcgcaattacattaattcgggtttcgggaatgatgtgcttta

SEQ ID NO: 3032 - DNA, 55 bp, Artificial Sequence
  Synthetic polynucleotide
agatatacagacgactctcgagaagtatttgggaagatatagagtcgtttggaga

SEQ ID NO: 3033 - DNA, 55 bp, Artificial Sequence
  Synthetic polynucleotide
ttattcaagctctggacagacatcatatatcggccatgagtatatcctaatgtct

SEQ ID NO: 3034 - DNA, 55 bp, Artificial Sequence
  Synthetic polynucleotide
aaatactacaattcttcttgggtgctctttagggctatcaacattctcaaccgat

SEQ ID NO: 3035 - DNA, 55 bp, Artificial Sequence
  Synthetic polynucleotide
tggatagcatagaacacatgctgtctgttgtggaaaatgtctacgaatatggtct

SEQ ID NO: 3036 - DNA, 55 bp, Artificial Sequence
  Synthetic polynucleotide
atcggttctttttatactgtgaagtcagtaaggcgctaaagagtgtaaaaccatg

SEQ ID NO: 3037 - DNA, 55 bp, Artificial Sequence
  Synthetic polynucleotide
tatctgctaacatatgcgcctgcgaaagcatgggtgcattttcattcatttgtat

SEQ ID NO: 3038 - DNA, 55 bp, Artificial Sequence
  Synthetic polynucleotide
ggtactggtaatcgacctaatcgacagcaaaggagactaaacatattattctcct

SEQ ID NO: 3039 - DNA, 55 bp, Artificial Sequence
  Synthetic polynucleotide
aactacagttttgatactagactgacgatcgggctttggaaactagtcatacgat

SEQ ID NO: 3040 - DNA, 55 bp, Artificial Sequence
  Synthetic polynucleotide
tctttaagcattatggcaacattcagcatatggcttagcctgaagactaaaaggg

SEQ ID NO: 3041 - DNA, 55 bp, Artificial Sequence
  Synthetic polynucleotide
cgtaatagtctatatgcgaggtgacaacacaggtattgtgtgttttctaatggtt

SEQ ID NO: 3042 - DNA, 55 bp, Artificial Sequence
  Synthetic polynucleotide
atttataagcatatgtccctagaccgtaggcgggtctttgtatcatacagtgatt

SEQ ID NO: 3043 - DNA, 55 bp, Artificial Sequence
  Synthetic polynucleotide
gaatctatgcctaagacgaggttagatcggaggagtaaatgcataccacttaatt

SEQ ID NO: 3044 - DNA, 55 bp, Artificial Sequence
  Synthetic polynucleotide
aactggtaacgtatatcacgatggataaatcgggagtctggctaagctcgaccaa

SEQ ID NO: 3045 - DNA, 55 bp, Artificial Sequence
  Synthetic polynucleotide
cgacgcacgaatatctcgcggtcgtaaatgaggtatctaatagaatggatatatc

SEQ ID NO: 3046 - DNA, 55 bp, Artificial Sequence
  Synthetic polynucleotide
agaaccctcatctgaactctctactattcttggatacaaaagacggactgtccgg

SEQ ID NO: 3047 - DNA, 55 bp, Artificial Sequence
  Synthetic polynucleotide
agaagtttgctgcgcccgaacttagtaactcggacgaccgtattatgtaacatgt

SEQ ID NO: 3048 - DNA, 55 bp, Artificial Sequence
  Synthetic polynucleotide
gggttgtgaatcatcacactctctgttctttggagtttccaatcgtttagccact

SEQ ID NO: 3049 - DNA, 55 bp, Artificial Sequence
  Synthetic polynucleotide
cttatattggcctcggcctgatagttatctcggtagtatcaccccaaaatatggg

SEQ ID NO: 3050 - DNA, 55 bp, Artificial Sequence
  Synthetic polynucleotide
gacgaatgggttccagcaaaaagtacagcatggtattgccattcccaggattcaa

SEQ ID NO: 3051 - DNA, 55 bp, Artificial Sequence
  Synthetic polynucleotide
ctttggtgttacacttcaatttgctatggccggtgtctaggtgctaaggttacaa

SEQ ID NO: 3052 - DNA, 55 bp, Artificial Sequence
  Synthetic polynucleotide
ttgtaagtacttagcccaacgaatcggtcctggtgggttgattatatcaggaagc

SEQ ID NO: 3053 - DNA, 55 bp, Artificial Sequence
  Synthetic polynucleotide
gttactagagctttcacgtcaggtgaggtatggtatcaagaccatgaatctaaac

SEQ ID NO: 3054 - DNA, 55 bp, Artificial Sequence
  Synthetic polynucleotide
tgagagttgaactgatccgaggtcatctgtgggtagccattttatcagatatggg

SEQ ID NO: 3055 - DNA, 55 bp, Artificial Sequence
  Synthetic polynucleotide
gtggggagattacagaccgtataggtctgaaggcttacattgatactatagggca

SEQ ID NO: 3056 - DNA, 55 bp, Artificial Sequence
  Synthetic polynucleotide
acaccatcggtacatacaagggatttcaggaggcagaatcaactaaacagacaac

SEQ ID NO: 3057 - DNA, 55 bp, Artificial Sequence
  Synthetic polynucleotide
attgatttgctaacgtcatgagtagagggccgggagccaaatatacgacttctta

SEQ ID NO: 3058 - DNA, 55 bp, Artificial Sequence
  Synthetic polynucleotide
gccacttcagtagcttcacaactgaccgatcggtgtgtactacattgatttagta

SEQ ID NO: 3059 - DNA, 55 bp, Artificial Sequence
  Synthetic polynucleotide
ccctgggactacaatgctgtcgtttcatctcggatgtgatcgcactctatacacg

SEQ ID NO: 3060 - DNA, 55 bp, Artificial Sequence
  Synthetic polynucleotide
gccttaggcacactgccggcgtccataatcgggcaaacaactgatggccgcgata

SEQ ID NO: 3061 - DNA, 55 bp, Artificial Sequence
  Synthetic polynucleotide
actgtatcgctatctactaacctggtttcgaggggtgtgcctctcttatcattcc

SEQ ID NO: 3062 - DNA, 55 bp, Artificial Sequence
  Synthetic polynucleotide
tacttattgcctatgtctgttcctctagctgggcaagcctaagggccaaacgcct

SEQ ID NO: 3063 - DNA, 55 bp, Artificial Sequence
  Synthetic polynucleotide
ttaccatcaggttgaccctcttgttgtttctggtgcagggtcgcccggaccccat

SEQ ID NO: 3064 - DNA, 55 bp, Artificial Sequence
  Synthetic polynucleotide
tgactcgacgcttgctcatggtgcgagcctgggtaatctaacaaacgtccatcct

SEQ ID NO: 3065 - DNA, 55 bp, Artificial Sequence
  Synthetic polynucleotide
tggcagagcacagttgcgtccggcagtaaatggcgttctcataaaccttaggaag

SEQ ID NO: 3066 - DNA, 55 bp, Artificial Sequence
  Synthetic polynucleotide
gctagttactgcacagccttcaatttggccagggacgagagagcatgttgagcct

SEQ ID NO: 3067 - DNA, 55 bp, Artificial Sequence
  Synthetic polynucleotide
ctcccggtacacgacccggtcaggtgactctggaaattctgtccggcctaaatat

SEQ ID NO: 3068 - DNA, 55 bp, Artificial Sequence
  Synthetic polynucleotide
agaattattttgaggacaaaaagaaggaactggcccgtttccaggagacccgtcc

SEQ ID NO: 3069 - DNA, 55 bp, Artificial Sequence
  Synthetic polynucleotide
ccgaaccgagtgctgacattgagctaccctagggtctgtacagcggcagactacc

SEQ ID NO: 3070 - DNA, 55 bp, Artificial Sequence
  Synthetic polynucleotide
tgttaaccagtgagaccctttcggcgatgctggatacttatgtcctatccccaaa

SEQ ID NO: 3071 - DNA, 55 bp, Artificial Sequence
  Synthetic polynucleotide
gcccacatccgtcatccgatacttccgagacggatttaaccgatatggctcttac

SEQ ID NO: 3072 - DNA, 55 bp, Artificial Sequence
  Synthetic polynucleotide
acacgcgattaacgatcagaagaccgagtacggtcatgttagtcacgacggacgt

SEQ ID NO: 3073 - DNA, 55 bp, Artificial Sequence
  Synthetic polynucleotide
tcaactatctagaaggctcaagatcccgaatggcctcagtttaagtctaaggggc

SEQ ID NO: 3074 - DNA, 55 bp, Artificial Sequence
  Synthetic polynucleotide
tggggagcaccggcccctgacgggttgtttaggtcatcaccacaggtttggccca

SEQ ID NO: 3075 - DNA, 55 bp, Artificial Sequence
  Synthetic polynucleotide
cggagctccttcgtcgccccactcatttcaaggggctccgcgacattgcttgtcg

SEQ ID NO: 3076 - DNA, 55 bp, Artificial Sequence
  Synthetic polynucleotide
cagcacacgcccgggtcggaatcctcttatgggcactctgatggacggcatgcga

SEQ ID NO: 3077 - DNA, 55 bp, Artificial Sequence
  Synthetic polynucleotide
ccgcgggctggaggagcagcgacaggattttgggtcttgcattcgtgtgactccg

SEQ ID NO: 3078 - DNA, 55 bp, Artificial Sequence
  Synthetic polynucleotide
gttccacgaccactaacccagggtctctatcggtgcatcgccgggctgcggattc

SEQ ID NO: 3079 - DNA, 55 bp, Artificial Sequence
  Synthetic polynucleotide
gggcgcggtatgacgtccccttggcttatgagggcggatacactctctccagcgc

SEQ ID NO: 3080 - DNA, 55 bp, Artificial Sequence
  Synthetic polynucleotide
ctatccggacacggtccctgttccagcgtttggtgtgagcgcggggccgatatag

SEQ ID NO: 3081 - DNA, 55 bp, Artificial Sequence
  Synthetic polynucleotide
agtcgcggcccgccctccgctagcagcgacaggggaagagggtcaaacgggtccg

SEQ ID NO: 3082 - DNA, 55 bp, Artificial Sequence
  Synthetic polynucleotide
tgttcgtgcggctcagcctattaggtcccgagggtttgtaacctgccagcccgcc

SEQ ID NO: 3083 - DNA, 55 bp, Artificial Sequence
  Synthetic polynucleotide
gcgctccaggaccccccaagtcgaatacatcggcaacaagctgtcaggacgacgg

SEQ ID NO: 3084 - DNA, 55 bp, Artificial Sequence
  Synthetic polynucleotide
cagaggacgcgtacatcgcaagtccctgaagggcgtgacacgttggcaaccgggt

SEQ ID NO: 3085 - DNA, 55 bp, Artificial Sequence
  Synthetic polynucleotide
ccccgtctacaccgcgcccacaaaaatcgcgggataacgtcgggcgaatatgccc

SEQ ID NO: 3086 - DNA, 55 bp, Artificial Sequence
  Synthetic polynucleotide
aggcctcccaaacaacccccagaacgtcggcggatggttaacgttctgtgggccc

SEQ ID NO: 3087 - DNA, 55 bp, Artificial Sequence
  Synthetic polynucleotide
tggaccgaccgaccgcctatcgtgcaccgggggtagtccaggagtgaggtcccct

SEQ ID NO: 3088 - DNA, 55 bp, Artificial Sequence
  Synthetic polynucleotide
tgcggtacagtagtacccccacttgacatttggcggtcccgtggagggcagcgca

SEQ ID NO: 3089 - DNA, 55 bp, Artificial Sequence
  Synthetic polynucleotide
taccccttatgtattgcagtcaaataaatttggaccaataaagattacaatccat

SEQ ID NO: 3090 - DNA, 55 bp, Artificial Sequence
  Synthetic polynucleotide
acaaaatgtgcaccggcttgttaaataattgggaatttggaatagagttttaagt

SEQ ID NO: 3091 - DNA, 55 bp, Artificial Sequence
  Synthetic polynucleotide
atcccttagttccatacttacgtaataattcggcaaataagactatgaatttcca

SEQ ID NO: 3092 - DNA, 55 bp, Artificial Sequence
  Synthetic polynucleotide
ttctgaattctgtactcaccttgatagtaagggtatacaatgacgtatgattaaa

SEQ ID NO: 3093 - DNA, 55 bp, Artificial Sequence
  Synthetic polynucleotide
taatttaaatacttatctcggagtcatattaggggaattggatacggaatgtaag

SEQ ID NO: 3094 - DNA, 55 bp, Artificial Sequence
  Synthetic polynucleotide
gtatttttcggaaattccccttagatgttttggcaataataagttatatttccag

SEQ ID NO: 3095 - DNA, 55 bp, Artificial Sequence
  Synthetic polynucleotide
tagtctctttacatgacatgctaatagatctggtgactaataaacttctatgtca

SEQ ID NO: 3096 - DNA, 55 bp, Artificial Sequence
  Synthetic polynucleotide
tataaaaaataggacacatctcagaaaatcggggtccatatcagtaaaaaaacgt

SEQ ID NO: 3097 - DNA, 55 bp, Artificial Sequence
  Synthetic polynucleotide
aattttatagagttgtcgctcgataatatatggagtgtatacttcacgtatacat

SEQ ID NO: 3098 - DNA, 55 bp, Artificial Sequence
  Synthetic polynucleotide
ttcagtaaatttctaccataagtccgccacaggttaaaagtattattgcctttat

SEQ ID NO: 3099 - DNA, 55 bp, Artificial Sequence
  Synthetic polynucleotide
ttacggaataacagtacgatcttaaaggtatggtagatttgacgaataatgagat

SEQ ID NO: 3100 - DNA, 55 bp, Artificial Sequence
  Synthetic polynucleotide
taggtttaccttggatcattcaagaaaaggaggtccaatttaaatatgtgtgtta

SEQ ID NO: 3101 - DNA, 55 bp, Artificial Sequence
  Synthetic polynucleotide
tccgagctgtgtatatcatatgttcaggggaggtaaaatatgttaatttttagaa

SEQ ID NO: 3102 - DNA, 55 bp, Artificial Sequence
  Synthetic polynucleotide
tcatattgatttctggctgataagcatgactggtttagggtgaaaaaagtaaaat

SEQ ID NO: 3103 - DNA, 55 bp, Artificial Sequence
  Synthetic polynucleotide
acatgaggacaacagtctttaaaaatgaggtggcttaacttctataattcgtaaa

SEQ ID NO: 3104 - DNA, 55 bp, Artificial Sequence
  Synthetic polynucleotide
gatcattcattttcaccgtggctcataattgggtataccaggtttaaccctaaac

SEQ ID NO: 3105 - DNA, 55 bp, Artificial Sequence
  Synthetic polynucleotide
taaatttatgcgctttctgtttcatattctaggctcttaacagtacatcctaacg

SEQ ID NO: 3106 - DNA, 55 bp, Artificial Sequence
  Synthetic polynucleotide
tttctggaaacacattcgtaaggattattttggtaacattacggtgccatcggag

SEQ ID NO: 3107 - DNA, 55 bp, Artificial Sequence
  Synthetic polynucleotide
gaaacgtcacttagttcctagcgagtctctgggtagtgaaataagaactttaaga

SEQ ID NO: 3108 - DNA, 55 bp, Artificial Sequence
  Synthetic polynucleotide
tttattgaatccaattcgttggacttatctaggtggcccttctttcaatcggcaa

SEQ ID NO: 3109 - DNA, 55 bp, Artificial Sequence
  Synthetic polynucleotide
ggagttaggcttgttactttatcctttgcaaggttttttagcgtaataacccata

SEQ ID NO: 3110 - DNA, 55 bp, Artificial Sequence
  Synthetic polynucleotide
tccttcccaattgtttctagttcgctgatatggtgtttctaaatacccgatgaga

SEQ ID NO: 3111 - DNA, 55 bp, Artificial Sequence
  Synthetic polynucleotide
aacactccctgttctacagattgcttgtactggtgaacaacatattggtattcaa

SEQ ID NO: 3112 - DNA, 55 bp, Artificial Sequence
  Synthetic polynucleotide
taaatgtattcacaatctgagtggcaatacgggtaaaccattcatagagcaagat

SEQ ID NO: 3113 - DNA, 55 bp, Artificial Sequence
  Synthetic polynucleotide
taaaaaaataaacaggctttctccaactgcaggagacctgacgagagtgtaaact

SEQ ID NO: 3114 - DNA, 55 bp, Artificial Sequence
  Synthetic polynucleotide
cttccagggccttatgcttctaataagcgtaggttctcataggttacaaataatt

SEQ ID NO: 3115 - DNA, 55 bp, Artificial Sequence
  Synthetic polynucleotide
caatctgtctatttgccgagcataagaacatggaatcctccaaagtttgcataca

SEQ ID NO: 3116 - DNA, 55 bp, Artificial Sequence
  Synthetic polynucleotide
ttagtgctatagccctcgataatacaggtagggacgcaactaacataaaataata

SEQ ID NO: 3117 - DNA, 55 bp, Artificial Sequence
  Synthetic polynucleotide
gaatatagcatagaccccttcaagtaacgttgggtccttaaccttttatttttag

SEQ ID NO: 3118 - DNA, 55 bp, Artificial Sequence
  Synthetic polynucleotide
tataggactgagactccagacctatcctgcaggatatgcaataacaattaaccaa

SEQ ID NO: 3119 - DNA, 55 bp, Artificial Sequence
  Synthetic polynucleotide
ttactttcagggaaccctggggtttattctcggctattaacagcaaatatatgcg

SEQ ID NO: 3120 - DNA, 55 bp, Artificial Sequence
  Synthetic polynucleotide
tcctagatggtcaagcctgcgctaatttactgggaacatcaacttggctaaatag

SEQ ID NO: 3121 - DNA, 55 bp, Artificial Sequence
  Synthetic polynucleotide
tatcacgagaactcaccctctgcgttattgtgggttccttatcgctaaaaaagcg

SEQ ID NO: 3122 - DNA, 55 bp, Artificial Sequence
  Synthetic polynucleotide
gagaactttctagagtcatatgcgtgttataggttactatcagatgccgtaagcc

SEQ ID NO: 3123 - DNA, 55 bp, Artificial Sequence
  Synthetic polynucleotide
gggcttgtatctggcgcagcatagaattatcggaaaatactggcagatactgcat

SEQ ID NO: 3124 - DNA, 55 bp, Artificial Sequence
  Synthetic polynucleotide
ctagcttgtgtgagatcacggtacgtttaagggcttacgcttagagattgtgcat

SEQ ID NO: 3125 - DNA, 55 bp, Artificial Sequence
  Synthetic polynucleotide
cactcggtgttaaaaccaggcccgaatagagggtgtagatcagatttaacctcat

SEQ ID NO: 3126 - DNA, 55 bp, Artificial Sequence
  Synthetic polynucleotide
agattttggatatgggccatgtagtatcatcggccgttataggtggcctaaatgt

SEQ ID NO: 3127 - DNA, 55 bp, Artificial Sequence
  Synthetic polynucleotide
agacgtcagtcccgtgcttgataaagtaaatggtcgcaactaatgcctattagac

SEQ ID NO: 3128 - DNA, 55 bp, Artificial Sequence
  Synthetic polynucleotide
tgagggtataatctttctttgtagcaaagatggatatgccactacctgtagcggg

SEQ ID NO: 3129 - DNA, 55 bp, Artificial Sequence
  Synthetic polynucleotide
aaagattgcgtattagcagaagtaagcgctggggccttcttatgaataccaagcc

SEQ ID NO: 3130 - DNA, 55 bp, Artificial Sequence
  Synthetic polynucleotide
accgttaaaaatgacccatacgtcacagagggggtgtccgtcatgataattactc

SEQ ID NO: 3131 - DNA, 55 bp, Artificial Sequence
  Synthetic polynucleotide
gcactgtgatgctacacggaatggaacgtaaggcttcgttagacttggataaaag

SEQ ID NO: 3132 - DNA, 55 bp, Artificial Sequence
  Synthetic polynucleotide
agtgcccgttatgacgcactgaatcgtagaaggcttttttattaacgtctcggct

SEQ ID NO: 3133 - DNA, 55 bp, Artificial Sequence
  Synthetic polynucleotide
ctagatactatgagttcttcaataccgtggtggtctcctccgctaacccactaaa

SEQ ID NO: 3134 - DNA, 55 bp, Artificial Sequence
  Synthetic polynucleotide
acaatgagctgccgcccacgttatgcttctgggattaaggaccgtagcagagggc

SEQ ID NO: 3135 - DNA, 55 bp, Artificial Sequence
  Synthetic polynucleotide
caagcatgttctgtctcggtttacctttccaggcccaaggtcgccgtgtgtctag

SEQ ID NO: 3136 - DNA, 55 bp, Artificial Sequence
  Synthetic polynucleotide
ttgttcagccagtggccgccttgctttctatggtcgatccgtagcatgagattct

SEQ ID NO: 3137 - DNA, 55 bp, Artificial Sequence
  Synthetic polynucleotide
gccatcgccttgacagccctgcaggagttgtggtcactcaacggttgtcgcagag

SEQ ID NO: 3138 - DNA, 55 bp, Artificial Sequence
  Synthetic polynucleotide
tggggttaactatagcccgctacatgaaactggtgtcaccatgatgcccttgtgt

SEQ ID NO: 3139 - DNA, 55 bp, Artificial Sequence
  Synthetic polynucleotide
gagtgtcgagccgacccagtgttgtactctgggccaagtccatcctctgggaaaa

SEQ ID NO: 3140 - DNA, 55 bp, Artificial Sequence
  Synthetic polynucleotide
gccgtactccttattacagggatgttactacggagaacctggccttgttttagcg

SEQ ID NO: 3141 - DNA, 55 bp, Artificial Sequence
  Synthetic polynucleotide
tctgaggtgcgcaatgcaccattagcacccgggtggaattttgaaatgctcatgc

SEQ ID NO: 3142 - DNA, 55 bp, Artificial Sequence
  Synthetic polynucleotide
aatagcaaataggtccccgccagatatgaatggcaacgcaaggtgaggatctccg

SEQ ID NO: 3143 - DNA, 55 bp, Artificial Sequence
  Synthetic polynucleotide
tggtctcgttaatgttctaaagaaccgcagtgggttctggcgtcgtggccagggt

SEQ ID NO: 3144 - DNA, 55 bp, Artificial Sequence
  Synthetic polynucleotide
cctgatctgaaacaagcatccgacaaaccctggtgtcgtcgattattggtcgccc

SEQ ID NO: 3145 - DNA, 55 bp, Artificial Sequence
  Synthetic polynucleotide
cgctggggcgtgtagcccttagtatgtaaccggaggttcgggactatggcgaaga

SEQ ID NO: 3146 - DNA, 55 bp, Artificial Sequence
  Synthetic polynucleotide
tacgttggtcaacgtaccatcatagagaggcggttggacgcactatttcggggta

SEQ ID NO: 3147 - DNA, 55 bp, Artificial Sequence
  Synthetic polynucleotide
atcaaccttcggatctccgatatagcgagatggaaggggggtcaacaccagtcaa

SEQ ID NO: 3148 - DNA, 55 bp, Artificial Sequence
  Synthetic polynucleotide
gaatggaacgacatgaccggtctaacgagatggttaatctcacagcactatgagc

SEQ ID NO: 3149 - DNA, 55 bp, Artificial Sequence
  Synthetic polynucleotide
agtgccatgcccctgcccccccgatgtttcgggagtggggggtatttcgtgcgca

SEQ ID NO: 3150 - DNA, 55 bp, Artificial Sequence
  Synthetic polynucleotide
ctgcccttggggcagtcctggggagattctcggactcgactctcgagacccccat

SEQ ID NO: 3151 - DNA, 55 bp, Artificial Sequence
  Synthetic polynucleotide
agactgacgcgcgctacggcctctatttcgaggcaagacgtgggacgcgggtgga

SEQ ID NO: 3152 - DNA, 55 bp, Artificial Sequence
  Synthetic polynucleotide
aggcatagcacgcttcccggatacagtttgtggcggtcccaaggccttcgcctcc

SEQ ID NO: 3153 - DNA, 55 bp, Artificial Sequence
  Synthetic polynucleotide
cgcgtagatcgacgagcggggacggactctaggctggcttgatcaccctgtccac

SEQ ID NO: 3154 - DNA, 55 bp, Artificial Sequence
  Synthetic polynucleotide
tgagcggcgcggccccctgtcacatcgctttgggagccggagccatgttgtagta

SEQ ID NO: 3155 - DNA, 55 bp, Artificial Sequence
  Synthetic polynucleotide
ccgtcctccgatccaactgtggaccatatgaggcggcatcacccaatccagcgcg

SEQ ID NO: 3156 - DNA, 55 bp, Artificial Sequence
  Synthetic polynucleotide
gtcatgccgtcccttcccccccggcgagttaggatctatcgtgagagctcgcagc

SEQ ID NO: 3157 - DNA, 55 bp, Artificial Sequence
  Synthetic polynucleotide
tcagacaatccgagagcctgagcaataccgggggcgtaggccacactgagcccgg

SEQ ID NO: 3158 - DNA, 55 bp, Artificial Sequence
  Synthetic polynucleotide
ccctgacctcctcagtctatagcccccgcgtggggggtcagcggggacatcaccg

SEQ ID NO: 3159 - DNA, 55 bp, Artificial Sequence
  Synthetic polynucleotide
ctacttaggacatcaacgaagtagaacataaggcgtccgcgcgggcggccgcgcc

SEQ ID NO: 3160 - DNA, 55 bp, Artificial Sequence
  Synthetic polynucleotide
gacgccgcggctgcccctggaacaccatgagggtgcgagcggaggtgagatcatg

SEQ ID NO: 3161 - DNA, 55 bp, Artificial Sequence
  Synthetic polynucleotide
gcctcgcccatacgcgcgaggaccctgtgatggaatttagtccgaacgcttgcgc

SEQ ID NO: 3162 - DNA, 55 bp, Artificial Sequence
  Synthetic polynucleotide
cgtgtagaggcgccgacgctatcttatggcgggtcctcgggtttcgcttcacctg

SEQ ID NO: 3163 - DNA, 55 bp, Artificial Sequence
  Synthetic polynucleotide
agcacccagcggactaccaatgttagacgccggctgtcggtcgcaatcgagctgg

SEQ ID NO: 3164 - DNA, 55 bp, Artificial Sequence
  Synthetic polynucleotide
tatctcgtatatatttcggagcgttaaatctgggaatagtattacgatcattgaa

SEQ ID NO: 3165 - DNA, 55 bp, Artificial Sequence
  Synthetic polynucleotide
cgctacaatcgtatttctatactaatttatcgggtggactttatatcgttaaatg

SEQ ID NO: 3166 - DNA, 55 bp, Artificial Sequence
  Synthetic polynucleotide
ttattttattatatttctgatcaataattttggatagcggcttcgattgaaggta

SEQ ID NO: 3167 - DNA, 55 bp, Artificial Sequence
  Synthetic polynucleotide
acaatagtagaatatccctgtgattgatttaggtatgttatctctcaaaaggtat

SEQ ID NO: 3168 - DNA, 55 bp, Artificial Sequence
  Synthetic polynucleotide
gatatacttaggcgaacgacgtgaaaaataaggctccgtttaaatagtttaaaat

SEQ ID NO: 3169 - DNA, 55 bp, Artificial Sequence
  Synthetic polynucleotide
aggaataagtagttatcaggcatttaaaagtggtaccattcttctttcttacttg

SEQ ID NO: 3170 - DNA, 55 bp, Artificial Sequence
  Synthetic polynucleotide
taattcttatgctaggctgagacaatcatttgggtaccatgaagacatataaaaa

SEQ ID NO: 3171 - DNA, 55 bp, Artificial Sequence
  Synthetic polynucleotide
ttatgattcactctcacatgtcatgtacttcggatttgttttagcttatgatagt

SEQ ID NO: 3172 - DNA, 55 bp, Artificial Sequence
  Synthetic polynucleotide
agctacatcgcagaagcatatttaattacagggattacatgtcatgatatctttt

SEQ ID NO: 3173 - DNA, 55 bp, Artificial Sequence
  Synthetic polynucleotide
ctttttctgacaagttcttacaaaactgaatggaaaatacccaaccttcttactt

SEQ ID NO: 3174 - DNA, 55 bp, Artificial Sequence
  Synthetic polynucleotide
gattatcaagatggatcctaataaattagctggaatatcagttttaaaaagcctt

SEQ ID NO: 3175 - DNA, 55 bp, Artificial Sequence
  Synthetic polynucleotide
gtatcaacctacgattcgattaaaatggtacggttcatgaattaaatatagatta

SEQ ID NO: 3176 - DNA, 55 bp, Artificial Sequence
  Synthetic polynucleotide
tttatttttaatttagccagtactgacaggcggtttattaaaagtgattttgact

SEQ ID NO: 3177 - DNA, 55 bp, Artificial Sequence
  Synthetic polynucleotide
gtccaaatttaaagacctgatatgaaccaaaggtttaaacggtgttcaaaatata

SEQ ID NO: 3178 - DNA, 55 bp, Artificial Sequence
  Synthetic polynucleotide
gttgttgtgactgaatcgaaattcagtggatggcgacaaaataatttaagaataa

SEQ ID NO: 3179 - DNA, 55 bp, Artificial Sequence
  Synthetic polynucleotide
aaccatcatttccgtccaaacatttatttctgggtctagtttcaagaggaatcaa

SEQ ID NO: 3180 - DNA, 55 bp, Artificial Sequence
  Synthetic polynucleotide
ttacggttgacacacacgggtatcttaaattggccatcatggttattgaaaaaag

SEQ ID NO: 3181 - DNA, 55 bp, Artificial Sequence
  Synthetic polynucleotide
acgcattatgagacaacttcctgtttaattcggaacatcagtttaccgacataaa

SEQ ID NO: 3182 - DNA, 55 bp, Artificial Sequence
  Synthetic polynucleotide
ttgtctttctctaaagctatgttagtaattgggtgcagcacctatgttgggtact

SEQ ID NO: 3183 - DNA, 55 bp, Artificial Sequence
  Synthetic polynucleotide
ttgtaaatccgagcatcagtccccgaattaaggtgctagcgaaaaagctattata

SEQ ID NO: 3184 - DNA, 55 bp, Artificial Sequence
  Synthetic polynucleotide
ctcattcatggcctagcctctagcgaattatgggctttcatactagaataaagat

SEQ ID NO: 3185 - DNA, 55 bp, Artificial Sequence
  Synthetic polynucleotide
ttttggtctaatacatctcgttagcagttttggtgacgagaaatgtggctacaag

SEQ ID NO: 3186 - DNA, 55 bp, Artificial Sequence
  Synthetic polynucleotide
ttactccaattctacgctataagacataaccggtcgaactatatgagtcgtagct

SEQ ID NO: 3187 - DNA, 55 bp, Artificial Sequence
  Synthetic polynucleotide
accataaaatttagctcctttctttaggtgcggtaaaggttccatttcttcgtct

SEQ ID NO: 3188 - DNA, 55 bp, Artificial Sequence
  Synthetic polynucleotide
ctactccatagtcagacgaaaatcaaagaggggaattctcagataaatacagtgt

SEQ ID NO: 3189 - DNA, 55 bp, Artificial Sequence
  Synthetic polynucleotide
aatctgtattaggtgaccagcacataagggaggggatacctatcgtatttaatac

SEQ ID NO: 3190 - DNA, 55 bp, Artificial Sequence
  Synthetic polynucleotide
aaatctgagtgtacagcttatatttagagggggggtaagtgattaatagcaacgg

SEQ ID NO: 3191 - DNA, 55 bp, Artificial Sequence
  Synthetic polynucleotide
agaagttgagaatgtgcacagtaatcctggaggaacatatacacatgaagtaaga

SEQ ID NO: 3192 - DNA, 55 bp, Artificial Sequence
  Synthetic polynucleotide
agatatcaatagcccccagatatcaatcggaggaacatccactttcttgatatct

SEQ ID NO: 3193 - DNA, 55 bp, Artificial Sequence
  Synthetic polynucleotide
aatggggccgcgtaaacagaatttcctagtgggattgactattgaaatctagtta

SEQ ID NO: 3194 - DNA, 55 bp, Artificial Sequence
  Synthetic polynucleotide
gtgatgcatggaatgcctcctgacatttctaggtaatctgctccgataaagtcta

SEQ ID NO: 3195 - DNA, 55 bp, Artificial Sequence
  Synthetic polynucleotide
tgcagcacaccgttgtcggatatcttaatttgggcattgtacacctatccatact

SEQ ID NO: 3196 - DNA, 55 bp, Artificial Sequence
  Synthetic polynucleotide
aaatccagtcgctggcccttgtacttaattcggggctttgacttttaaggttcac

SEQ ID NO: 3197 - DNA, 55 bp, Artificial Sequence
  Synthetic polynucleotide
catagccctccaaggacatactgctaattatggtctcacagatagactctaactc

SEQ ID NO: 3198 - DNA, 55 bp, Artificial Sequence
  Synthetic polynucleotide
agcatgtcgccaatagccaccttgactttatggtcccaagtctagtttatggtta

SEQ ID NO: 3199 - DNA, 55 bp, Artificial Sequence
  Synthetic polynucleotide
gtctagataagggatgcagtgaacaaattatggaagctcaagcgagcgcaacttt

SEQ ID NO: 3200 - DNA, 55 bp, Artificial Sequence
  Synthetic polynucleotide
tgtctcggctctttcacaagtaagtattcggggatctctcgaagttgatctacta

SEQ ID NO: 3201 - DNA, 55 bp, Artificial Sequence
  Synthetic polynucleotide
attaggaacaacgtatcagttcttgtggcacggtacctttactgctgaacagaat

SEQ ID NO: 3202 - DNA, 55 bp, Artificial Sequence
  Synthetic polynucleotide
aattgatgtgctttggctccacgaatactgtggtttacaaaagcgcaaacagcag

SEQ ID NO: 3203 - DNA, 55 bp, Artificial Sequence
  Synthetic polynucleotide
gctctagtagtctttgcaagagaacttggttggcctgtatgttagctactttgaa

SEQ ID NO: 3204 - DNA, 55 bp, Artificial Sequence
  Synthetic polynucleotide
tcggtttaggtataatcagcccacgacaaatggttgctgagaacactcctgtaga

SEQ ID NO: 3205 - DNA, 55 bp, Artificial Sequence
  Synthetic polynucleotide
tgggtgtactcctttacactacataaagccaggttacaaatgacagcgtccgata

SEQ ID NO: 3206 - DNA, 55 bp, Artificial Sequence
  Synthetic polynucleotide
tccacaaacaggaagacttcagtacacgcccgggtgttgctaacaatgttttcat

SEQ ID NO: 3207 - DNA, 55 bp, Artificial Sequence
  Synthetic polynucleotide
taagattcgacgtcctcaaacttagacgtgcgggaaagaattcatttcgtagagg

SEQ ID NO: 3208 - DNA, 55 bp, Artificial Sequence
  Synthetic polynucleotide
gccagtcaataggtgacgtcatatcgctgaaggaaaagacttaaaaggctcggtt

SEQ ID NO: 3209 - DNA, 55 bp, Artificial Sequence
  Synthetic polynucleotide
gcgttgtgacttggctcgcgtaacttaaaagggcctgcgtttagattagagaccg

SEQ ID NO: 3210 - DNA, 55 bp, Artificial Sequence
  Synthetic polynucleotide
cggactcctggaaggaccactagattaaatgggcagaagtgcacattggggtagg

SEQ ID NO: 3211 - DNA, 55 bp, Artificial Sequence
  Synthetic polynucleotide
gcaagcacccgagcggccgtttccctttcagggtatgttttgtcaacgtgctctt

SEQ ID NO: 3212 - DNA, 55 bp, Artificial Sequence
  Synthetic polynucleotide
ccctgcctgctcgtagcagctcctatataacggggctgtccataataatagtctg

SEQ ID NO: 3213 - DNA, 55 bp, Artificial Sequence
  Synthetic polynucleotide
gcgggatcaattgagccgttggcttagtaacggacactagcagagatgtgttgca

SEQ ID NO: 3214 - DNA, 55 bp, Artificial Sequence
  Synthetic polynucleotide
cgatcgctgcaggggtctcccgttacatcttggaattattgagtttcggcatggc

SEQ ID NO: 3215 - DNA, 55 bp, Artificial Sequence
  Synthetic polynucleotide
ccctggtaggtgattccaattcccgtagctgggattagctatcagttggcctcat

SEQ ID NO: 3216 - DNA, 55 bp, Artificial Sequence
  Synthetic polynucleotide
accacccgaggcaattcgagcagacgaattaggggtacattgtttgtcacccggg

SEQ ID NO: 3217 - DNA, 55 bp, Artificial Sequence
  Synthetic polynucleotide
cctctgcaccgttattctcaaccgcatctgtggacacactgaagtgaaccaccta

SEQ ID NO: 3218 - DNA, 55 bp, Artificial Sequence
  Synthetic polynucleotide
taacaaaagagactgccctcgaaccgaggttggcctggaaatactggactgggga

SEQ ID NO: 3219 - DNA, 55 bp, Artificial Sequence
  Synthetic polynucleotide
tctcttctcggtccatcccataccgctgggggggcatatgcatagggcatagctt

SEQ ID NO: 3220 - DNA, 55 bp, Artificial Sequence
  Synthetic polynucleotide
ccagtgggtgtcataacttgactctattgcagggtcacgggatgagagctctgtg

SEQ ID NO: 3221 - DNA, 55 bp, Artificial Sequence
  Synthetic polynucleotide
gaggcagtaactgcgcctgttcacaacgagagggtcccaggtaagaacccgactt

SEQ ID NO: 3222 - DNA, 55 bp, Artificial Sequence
  Synthetic polynucleotide
ctgcttcgccggagatcccgaaacaccggctggctaagtgcgattgaaagtacca

SEQ ID NO: 3223 - DNA, 55 bp, Artificial Sequence
  Synthetic polynucleotide
agtggatctaggagatctccttcccaatggtggtctgttatcgtctcccgtacaa

SEQ ID NO: 3224 - DNA, 55 bp, Artificial Sequence
  Synthetic polynucleotide
ccctctctgtgccctcccgctccgttataagggtagtaccaaagcgcccgcccgc

SEQ ID NO: 3225 - DNA, 55 bp, Artificial Sequence
  Synthetic polynucleotide
gctgtgactctcccagcgcgcactataaacaggtacgacgcaggtgagcgcgcag

SEQ ID NO: 3226 - DNA, 55 bp, Artificial Sequence
  Synthetic polynucleotide
atcctgaggatgctcacgcgaagcttaaacagggggcagtgggcccactcgctcc

SEQ ID NO: 3227 - DNA, 55 bp, Artificial Sequence
  Synthetic polynucleotide
cggagcgcaccgcgtgcgacggccaatatctgggttcacgacctagagttgtcga

SEQ ID NO: 3228 - DNA, 55 bp, Artificial Sequence
  Synthetic polynucleotide
gcgacaccggctgcctctgcgctctctaagtggccattgtgggtggcacagcact

SEQ ID NO: 3229 - DNA, 55 bp, Artificial Sequence
  Synthetic polynucleotide
cgcgcgtcccctgctccgactcttagttattggcgtgcccgacttccggcttctg

SEQ ID NO: 3230 - DNA, 55 bp, Artificial Sequence
  Synthetic polynucleotide
gccctcggatccggctcgcttccagcagtgaggatgggtatgccgacgttcaacc

SEQ ID NO: 3231 - DNA, 55 bp, Artificial Sequence
  Synthetic polynucleotide
cgggttggctgggctcccgacgcaccattgtgggctaagaggtgcgtatttcgcc

SEQ ID NO: 3232 - DNA, 55 bp, Artificial Sequence
  Synthetic polynucleotide
ccgtaccccgccgtcgcgccctatactgaagggacgctcaaaaccgtatcctctg

SEQ ID NO: 3233 - DNA, 55 bp, Artificial Sequence
  Synthetic polynucleotide
ggaacattctcctggcctagcctaacaggtaggggcgcgtgggttggtgccacgg

SEQ ID NO: 3234 - DNA, 55 bp, Artificial Sequence
  Synthetic polynucleotide
ccacccagtttaacgacaccactctgcgtaaggacgggatgtctggcgcacgccc

SEQ ID NO: 3235 - DNA, 55 bp, Artificial Sequence
  Synthetic polynucleotide
ccctcggtgcataagacctcctcgtccggtgggggttcttcatgcttacgagggg

SEQ ID NO: 3236 - DNA, 55 bp, Artificial Sequence
  Synthetic polynucleotide
tcccccccggtagtgacgcaatcacaagagggggtgctacccacgaggggagcga

SEQ ID NO: 3237 - DNA, 55 bp, Artificial Sequence
  Synthetic polynucleotide
acggtggcgagggcctccacttaacacggatgggagtgggggcaataaccccgac

SEQ ID NO: 3238 - DNA, 55 bp, Artificial Sequence
  Synthetic polynucleotide
ccagtcactagatcagcaactccgctgggtaggacgggttcggtcacccgtgctg

SEQ ID NO: 3239 - DNA, 55 bp, Artificial Sequence
  Synthetic polynucleotide
tatgttgttgatccttcctataggtaatttaggtattatccttagaaaaagacgg

SEQ ID NO: 3240 - DNA, 55 bp, Artificial Sequence
  Synthetic polynucleotide
attacaagcattctgtctgggtagtattctgggttctatagattactttaaacat

SEQ ID NO: 3241 - DNA, 55 bp, Artificial Sequence
  Synthetic polynucleotide
tggttttcctaaagtgcaatggttatttattggttatttcataggttatgataga

SEQ ID NO: 3242 - DNA, 55 bp, Artificial Sequence
  Synthetic polynucleotide
ggcattatgtaaagcccattcggatttctttggatttaatttttgtgcattgttt

SEQ ID NO: 3243 - DNA, 55 bp, Artificial Sequence
  Synthetic polynucleotide
tataataatatatatgctgggcactctatagggcacttatgattaatcataggtt

SEQ ID NO: 3244 - DNA, 55 bp, Artificial Sequence
  Synthetic polynucleotide
tcacagtttgcatttacacataatttgatttgggtctgataccacaatataattg

SEQ ID NO: 3245 - DNA, 55 bp, Artificial Sequence
  Synthetic polynucleotide
tatttcagtattattacttgaaaaaggaaagggaggtatgggaataatacctacg

SEQ ID NO: 3246 - DNA, 55 bp, Artificial Sequence
  Synthetic polynucleotide
gatatttattaatgtcctttgtgggtttgaagggtttttgagatattgctctttt

SEQ ID NO: 3247 - DNA, 55 bp, Artificial Sequence
  Synthetic polynucleotide
gacttgcttatacggtctaaaggtaataaaaggttaatttttgataataataatg

SEQ ID NO: 3248 - DNA, 55 bp, Artificial Sequence
  Synthetic polynucleotide
actataatgttagttgcaatgactaaccaatggcaaacatatgtatctactctaa

SEQ ID NO: 3249 - DNA, 55 bp, Artificial Sequence
  Synthetic polynucleotide
actatgggttataaagctgtaagagctaagaggtagcttttaatcattacataac

SEQ ID NO: 3250 - DNA, 55 bp, Artificial Sequence
  Synthetic polynucleotide
aatatcattgattacacatagtggattgattggatacggtgatgaaattctatat

SEQ ID NO: 3251 - DNA, 55 bp, Artificial Sequence
  Synthetic polynucleotide
ttagacgtactcgaacctaagaaacaaagtaggaaacaacattcacaatttcaat

SEQ ID NO: 3252 - DNA, 55 bp, Artificial Sequence
  Synthetic polynucleotide
aataattggatacgcgcaaattagaccagacggagccaactataataattatata

SEQ ID NO: 3253 - DNA, 55 bp, Artificial Sequence
  Synthetic polynucleotide
aattcaagagaaatgtcgatcatgaagtgaaggagatgtatttaagaccatttta

SEQ ID NO: 3254 - DNA, 55 bp, Artificial Sequence
  Synthetic polynucleotide
ttccgcatttccatatcactttcgtagtttcggatgtcgtaattttcgaactcga

SEQ ID NO: 3255 - DNA, 55 bp, Artificial Sequence
  Synthetic polynucleotide
ctgtgtataccttgttctgttggtctttcttggcatattgtacagattttctagc

SEQ ID NO: 3256 - DNA, 55 bp, Artificial Sequence
  Synthetic polynucleotide
gaacatcatctaatagctgcgtggtaaatgtggtaaaaagagtcaggtaaatttg

SEQ ID NO: 3257 - DNA, 55 bp, Artificial Sequence
  Synthetic polynucleotide
ttagtcaaattcgaagcgtttgccggaatccggagaagccagaaattttagattt

SEQ ID NO: 3258 - DNA, 55 bp, Artificial Sequence
  Synthetic polynucleotide
caacatatagatcaaacagtgtttggatttgggactaagttgttcacgaggaatg

SEQ ID NO: 3259 - DNA, 55 bp, Artificial Sequence
  Synthetic polynucleotide
aggttttctaaaggagcgattgcggtattttggtagcttgcactaaatcaaaatt

SEQ ID NO: 3260 - DNA, 55 bp, Artificial Sequence
  Synthetic polynucleotide
aagatatgcaggatcacattcagtggattgtggtgtcatttcggatcattgattg

SEQ ID NO: 3261 - DNA, 55 bp, Artificial Sequence
  Synthetic polynucleotide
gggttctgatatttagctcgtgtatagataggggtaacaatccatagtagcttaa

SEQ ID NO: 3262 - DNA, 55 bp, Artificial Sequence
  Synthetic polynucleotide
tctcacagccattacgcgatttatgggtgttggggtcatagaaaagactatttta

SEQ ID NO: 3263 - DNA, 55 bp, Artificial Sequence
  Synthetic polynucleotide
acattatacacatacacccgatccaggaacaggtaaagtacctcaagtcagaaaa

SEQ ID NO: 3264 - DNA, 55 bp, Artificial Sequence
  Synthetic polynucleotide
cgtttgcgtatgttatcgatgcgatcacgatggacaatgccttcatttcatttat

SEQ ID NO: 3265 - DNA, 55 bp, Artificial Sequence
  Synthetic polynucleotide
ctttcactcaaatagactatcaggcatcataggcaacgaagactattagagtgtc

SEQ ID NO: 3266 - DNA, 55 bp, Artificial Sequence
  Synthetic polynucleotide
gcttaatgattaatgacttgaagacaagacagggagtaattaagacctaggtacg

SEQ ID NO: 3267 - DNA, 55 bp, Artificial Sequence
  Synthetic polynucleotide
caattagcgaaaattccattaggtcaccacaggtttgcatgtcattatcacacgt

SEQ ID NO: 3268 - DNA, 55 bp, Artificial Sequence
  Synthetic polynucleotide
acactgctcataagcgctcaagatgaatgaaggtgcagaaattgaaccattgtta

SEQ ID NO: 3269 - DNA, 55 bp, Artificial Sequence
  Synthetic polynucleotide
gttaaggagttctttgcactttggttagttgggttaacaccaatcgtgtcgagcg

SEQ ID NO: 3270 - DNA, 55 bp, Artificial Sequence
  Synthetic polynucleotide
gttgttaccggtggtacgtatgggataaatgggaaatgacaaacgtgtatagagc

SEQ ID NO: 3271 - DNA, 55 bp, Artificial Sequence
  Synthetic polynucleotide
taagatttgcatctctccttgtgggcttcagggccattggtatatcagtaattca

SEQ ID NO: 3272 - DNA, 55 bp, Artificial Sequence
  Synthetic polynucleotide
ttagtaggctatctcactgctatttagttaggggctgtgcaaaacagacgtgagc

SEQ ID NO: 3273 - DNA, 55 bp, Artificial Sequence
  Synthetic polynucleotide
tggtgaatctagtggtccattcgggtattcgggcacaaaatggtggtaatactgt

SEQ ID NO: 3274 - DNA, 55 bp, Artificial Sequence
  Synthetic polynucleotide
tcatgcttgatacaggcatcctccttgtcttggtttcgtttcgacctatagtaat

SEQ ID NO: 3275 - DNA, 55 bp, Artificial Sequence
  Synthetic polynucleotide
gccatcacttattatgcgtagcacgagataaggacgagagttatcttacacgtgt

SEQ ID NO: 3276 - DNA, 55 bp, Artificial Sequence
  Synthetic polynucleotide
acagacgatgtagagacccatgtcaggccagggacataaattttattgtagggct

SEQ ID NO: 3277 - DNA, 55 bp, Artificial Sequence
  Synthetic polynucleotide
caactcttctatggggctaggtaagcagctaggcagttttttttactagttggtg

SEQ ID NO: 3278 - DNA, 55 bp, Artificial Sequence
  Synthetic polynucleotide
ctttaaagtgtgaacgcgttccggcagacccgggtgttaaatgtaaatttacatg

SEQ ID NO: 3279 - DNA, 55 bp, Artificial Sequence
  Synthetic polynucleotide
tttacgaatccttcatccaagggtagagactggtagactgggacttcgaattaat

SEQ ID NO: 3280 - DNA, 55 bp, Artificial Sequence
  Synthetic polynucleotide
agagttcaaggaaaagccttaaacggccaaaggccaatcacaatttgcaacgtcc

SEQ ID NO: 3281 - DNA, 55 bp, Artificial Sequence
  Synthetic polynucleotide
tccatgcgatgaagtaccgatattgctcgccggaattgctatctcattatccaag

SEQ ID NO: 3282 - DNA, 55 bp, Artificial Sequence
  Synthetic polynucleotide
tctagtctttatagtccgaaacctgacacctggcacctagatttaacttcgtact

SEQ ID NO: 3283 - DNA, 55 bp, Artificial Sequence
  Synthetic polynucleotide
ctataacaggaaagcgcaggaccttaccgcagggatactgaattaagttgatgtt

SEQ ID NO: 3284 - DNA, 55 bp, Artificial Sequence
  Synthetic polynucleotide
acgttaacaaacaattccgggcgtaatttccgggagccaggtccgactgatctca

SEQ ID NO: 3285 - DNA, 55 bp, Artificial Sequence
  Synthetic polynucleotide
tgtccgttacataagtccgttagggtttaagggaaactggccggattggccctgg

SEQ ID NO: 3286 - DNA, 55 bp, Artificial Sequence
  Synthetic polynucleotide
aaaaggaatggtcactctatccgggtttaacgggcccgaccggtcaaccaaaacc

SEQ ID NO: 3287 - DNA, 55 bp, Artificial Sequence
  Synthetic polynucleotide
ctacactggttgcatccttgacgcataccttggcgcggccaggaggaagttagga

SEQ ID NO: 3288 - DNA, 55 bp, Artificial Sequence
  Synthetic polynucleotide
atggtgccacaaatttcagccggaacaaaccggaccctttacgtgagaacgtgtc

SEQ ID NO: 3289 - DNA, 55 bp, Artificial Sequence
  Synthetic polynucleotide
cagtctggaccaaaagcgtgcttctgatctgggatctcttacacccttcgtggtc

SEQ ID NO: 3290 - DNA, 55 bp, Artificial Sequence
  Synthetic polynucleotide
cccgtaacgtacagggcatcataggtgcctcggtgttttctatccacgggcccta

SEQ ID NO: 3291 - DNA, 55 bp, Artificial Sequence
  Synthetic polynucleotide
ctgcgagaacttatgccgactttgcagttgcggagggcgaggaggttgaaggaac

SEQ ID NO: 3292 - DNA, 55 bp, Artificial Sequence
  Synthetic polynucleotide
aactggttcgctgtcccaactttcgtggcgtgggaggttttaggtaaatcagggg

SEQ ID NO: 3293 - DNA, 55 bp, Artificial Sequence
  Synthetic polynucleotide
gctctaacttagttgtcgtagtgggcgcgaaggtgggccacattcgtttgttgct

SEQ ID NO: 3294 - DNA, 55 bp, Artificial Sequence
  Synthetic polynucleotide
ttacgcgggttataagcgcgtaggcaatggtggcaatcaaacgttagttctgcgc

SEQ ID NO: 3295 - DNA, 55 bp, Artificial Sequence
  Synthetic polynucleotide
cgaaataacaggagttcctcttaccggatccggacacaatgacctatggtccgct

SEQ ID NO: 3296 - DNA, 55 bp, Artificial Sequence
  Synthetic polynucleotide
tacagcctagcacctaccagacctcaactcaggcgggaaacttataaaccgcact

SEQ ID NO: 3297 - DNA, 55 bp, Artificial Sequence
  Synthetic polynucleotide
tgacgctatagcggtcccgtaaaacagaacagggggagccgcggtatcggtcgga

SEQ ID NO: 3298 - DNA, 55 bp, Artificial Sequence
  Synthetic polynucleotide
actagcaattagtaaacatctatgcggaggcgggttactaccagcacgaggtcga

SEQ ID NO: 3299 - DNA, 55 bp, Artificial Sequence
  Synthetic polynucleotide
gcgcgggactcaggacctggcgcttattcttggcgctgtcaccggaacgtgcgag

SEQ ID NO: 3300 - DNA, 55 bp, Artificial Sequence
  Synthetic polynucleotide
atcgccgtcctcgacactcatggcctttccaggccgttggagcccggagtctact

SEQ ID NO: 3301 - DNA, 55 bp, Artificial Sequence
  Synthetic polynucleotide
gcgggtacgcaatccccgcactggacttctgggatccatagtacaggacccgcac

SEQ ID NO: 3302 - DNA, 55 bp, Artificial Sequence
  Synthetic polynucleotide
gcgattgccccgcgtccaggaggcagtttatggtggcaggactggtgtgtagacg

SEQ ID NO: 3303 - DNA, 55 bp, Artificial Sequence
  Synthetic polynucleotide
gtcgaagtagggcgccccgtcgctacttactggctagaattccgaacgggctcgg

SEQ ID NO: 3304 - DNA, 55 bp, Artificial Sequence
  Synthetic polynucleotide
gcgcgatgaaccgcgacgcggtccggcgttgggccaaaagtaaggaaatcccgct

SEQ ID NO: 3305 - DNA, 55 bp, Artificial Sequence
  Synthetic polynucleotide
ccaggaagagctactccatcactgggacttgggcgcgcctcgggccccaattagg

SEQ ID NO: 3306 - DNA, 55 bp, Artificial Sequence
  Synthetic polynucleotide
ccgtccgcggcggctccggcgacacgagacaggaaacaaacacacgctggcccgg

SEQ ID NO: 3307 - DNA, 55 bp, Artificial Sequence
  Synthetic polynucleotide
cacacttgacttcgcccgttaacggggcaacggatcagagagttgcgcgcggcgg

SEQ ID NO: 3308 - DNA, 55 bp, Artificial Sequence
  Synthetic polynucleotide
cacctccttcttcggccccggtacaacgtacggtaggactagtcgccggtcacca

SEQ ID NO: 3309 - DNA, 55 bp, Artificial Sequence
  Synthetic polynucleotide
ctttacccaggtccggcggaagcggacgacaggaccataaccatgtcacctggcc

SEQ ID NO: 3310 - DNA, 55 bp, Artificial Sequence
  Synthetic polynucleotide
tgttcctgaaggccgtctcccttgacgagacggaagagcaccgtcgggatggccc

SEQ ID NO: 3311 - DNA, 55 bp, Artificial Sequence
  Synthetic polynucleotide
tcggtgcgagttcatcccaactgtccgggccggaactccggagctcttggtgtgt

SEQ ID NO: 3312 - DNA, 55 bp, Artificial Sequence
  Synthetic polynucleotide
cctgcgtggagatctgccaggctctccaggcggtcataaactacgcgcccgtacg

SEQ ID NO: 3313 - DNA, 55 bp, Artificial Sequence
  Synthetic polynucleotide
ccagttcaaaagacacctcttctgcagcgcaggatcacgggcagcactgccgccc

SEQ ID NO: 3314 - DNA, 55 bp, Artificial Sequence
  Synthetic polynucleotide
tgaaagggcaaatctacaaaaataataaataggcttcaactcaccataattcact

SEQ ID NO: 3315 - DNA, 55 bp, Artificial Sequence
  Synthetic polynucleotide
tatagcctttcagggactatttgctatttatggcatgctatttatttgagtaact

SEQ ID NO: 3316 - DNA, 55 bp, Artificial Sequence
  Synthetic polynucleotide
gtggttactattacctcgtttctataattttggttctatatgataatgtataact

SEQ ID NO: 3317 - DNA, 55 bp, Artificial Sequence
  Synthetic polynucleotide
cttaaatgctccggtgcaaatagggaataatggaaatacaatagtttattctatg

SEQ ID NO: 3318 - DNA, 55 bp, Artificial Sequence
  Synthetic polynucleotide
actagcataagtaatcctaatggggatattaggatgttatggatttgatctttac

SEQ ID NO: 3319 - DNA, 55 bp, Artificial Sequence
  Synthetic polynucleotide
aaatggaggcgaaatgccttaaattgaatgaggtaataaattttaataatagcag

SEQ ID NO: 3320 - DNA, 55 bp, Artificial Sequence
  Synthetic polynucleotide
aaattgattgaaattgctaatttcaggacaaggctgttttttcagtctttgggtt

SEQ ID NO: 3321 - DNA, 55 bp, Artificial Sequence
  Synthetic polynucleotide
ggattagaatgaaagtcagagtagacatagagggaatacatataaagttttgcaa

SEQ ID NO: 3322 - DNA, 55 bp, Artificial Sequence
  Synthetic polynucleotide
ttattaatgtgttcacctggtaaagggttaaggatctgtacaatagtatggatta

SEQ ID NO: 3323 - DNA, 55 bp, Artificial Sequence
  Synthetic polynucleotide
tgattaaacatacaagctagtataaaggaaagggagtgtgcagatatataacgat

SEQ ID NO: 3324 - DNA, 55 bp, Artificial Sequence
  Synthetic polynucleotide
cattacatatgtgctactgatcgggtaggagggatataatatatattaatagttt

SEQ ID NO: 3325 - DNA, 55 bp, Artificial Sequence
  Synthetic polynucleotide
aagagtatatttcacacacgtttataaccacggattccttataaacgttgaaatt

SEQ ID NO: 3326 - DNA, 55 bp, Artificial Sequence
  Synthetic polynucleotide
ttgcataacaataaatcctatgaacaacaacggaaacatgataagatgtagcgat

SEQ ID NO: 3327 - DNA, 55 bp, Artificial Sequence
  Synthetic polynucleotide
tttaagataatttaaccgttagaacgacgaaggttatcaacagaactaaatggac

SEQ ID NO: 3328 - DNA, 55 bp, Artificial Sequence
  Synthetic polynucleotide
aaatagtggatttggccatgatagatctgatggccttagagatttatttttttct

SEQ ID NO: 3329 - DNA, 55 bp, Artificial Sequence
  Synthetic polynucleotide
atttatttatagttggctggtttgtcttctcggtctcttagctgtttaggcacag

SEQ ID NO: 3330 - DNA, 55 bp, Artificial Sequence
  Synthetic polynucleotide
aaaattattccaattgctattgcgtcttcttggacggatctcatgctctgtcgat

SEQ ID NO: 3331 - DNA, 55 bp, Artificial Sequence
  Synthetic polynucleotide
taaatacgacgtaattcgggtttggtatctcggtttaatggataagagtatagtt

SEQ ID NO: 3332 - DNA, 55 bp, Artificial Sequence
  Synthetic polynucleotide
ggaagacgcattaaaccagttggtaatttggggcagataagtaagttaattcata

SEQ ID NO: 3333 - DNA, 55 bp, Artificial Sequence
  Synthetic polynucleotide
agtgatagtaagtggtctctcctatgattgaggtgtaaagagaaagatcgtcgaa

SEQ ID NO: 3334 - DNA, 55 bp, Artificial Sequence
  Synthetic polynucleotide
gttacaatttcgttctctaatgtctgattctggatctggtgtttctgttggataa

SEQ ID NO: 3335 - DNA, 55 bp, Artificial Sequence
  Synthetic polynucleotide
tgttccggacataatgcacttgggaggaattggattatgaagctgaatgatcatt

SEQ ID NO: 3336 - DNA, 55 bp, Artificial Sequence
  Synthetic polynucleotide
taagaacataaacacgcaggggactcataagggcaatcattaggcaatttagatt

SEQ ID NO: 3337 - DNA, 55 bp, Artificial Sequence
  Synthetic polynucleotide
gcaatagtttaaagttctctggctagactggggccgtcatttctttagaatgaat

SEQ ID NO: 3338 - DNA, 55 bp, Artificial Sequence
  Synthetic polynucleotide
cttatgaaaccaggttctagtttatggtgggggagaatttcaattgagataagcc

SEQ ID NO: 3339 - DNA, 55 bp, Artificial Sequence
  Synthetic polynucleotide
cttatgaaatcatacacgctctgggatggtaggggttagacgatacattgattaa

SEQ ID NO: 3340 - DNA, 55 bp, Artificial Sequence
  Synthetic polynucleotide
cttactttccaaagtacaatgtaacgcaagcggtaaaataaattcgcaaccgggt

SEQ ID NO: 3341 - DNA, 55 bp, Artificial Sequence
  Synthetic polynucleotide
atgaagagcataggagctcaatagaaccataggaaacaatcatcactattcctgt

SEQ ID NO: 3342 - DNA, 55 bp, Artificial Sequence
  Synthetic polynucleotide
tgtttgagttaccaatcagaccaacacgactggtacatatcaaaccatgttctat

SEQ ID NO: 3343 - DNA, 55 bp, Artificial Sequence
  Synthetic polynucleotide
tttgccataagaaacacaggagagacagactggaaaagcctcattctgatgtttt

SEQ ID NO: 3344 - DNA, 55 bp, Artificial Sequence
  Synthetic polynucleotide
atatggccgcgcaattccgttgcatggttttggtttaagccgtttcaatttgctt

SEQ ID NO: 3345 - DNA, 55 bp, Artificial Sequence
  Synthetic polynucleotide
catcgattttaatgggcctttacattctttcggtagcacccatgctcttcttcct

SEQ ID NO: 3346 - DNA, 55 bp, Artificial Sequence
  Synthetic polynucleotide
ggatagcaccggaatacaacgggaaattatgggaggccttaaaaacctaaggtga

SEQ ID NO: 3347 - DNA, 55 bp, Artificial Sequence
  Synthetic polynucleotide
ctggattcgcaaataactgcgttgggactgaggagaaggatagtacgttattcct

SEQ ID NO: 3348 - DNA, 55 bp, Artificial Sequence
  Synthetic polynucleotide
tgtttagctgggctgtcatttggcagctataggccttggatctacttaaagagaa

SEQ ID NO: 3349 - DNA, 55 bp, Artificial Sequence
  Synthetic polynucleotide
caactgtcactccgagcggttgtgttggtttggcgagacaactaataaatttgag

SEQ ID NO: 3350 - DNA, 55 bp, Artificial Sequence
  Synthetic polynucleotide
cacatgtaattctgggcccagatggttgtttggtcttaacaatcaggattgtccg

SEQ ID NO: 3351 - DNA, 55 bp, Artificial Sequence
  Synthetic polynucleotide
tatccggtatttcttgcccgtaaaagggctagggtggtaaaatcctctcaggatt

SEQ ID NO: 3352 - DNA, 55 bp, Artificial Sequence
  Synthetic polynucleotide
gcttagcctataagtactggtttgggactctggcgctttttgcagtaacacatac

SEQ ID NO: 3353 - DNA, 55 bp, Artificial Sequence
  Synthetic polynucleotide
tagctttgataagacccgatatgtagagaatggggtagacgagtgagtatcctga

SEQ ID NO: 3354 - DNA, 55 bp, Artificial Sequence
  Synthetic polynucleotide
gtcttaaggtgcgggacaaccttaatgaaccggtaaacaatgccagaattctgtc

SEQ ID NO: 3355 - DNA, 55 bp, Artificial Sequence
  Synthetic polynucleotide
ttatgcgagtatatcgcaaagcttagggtgaggcgagtcttagatgatagagagt

SEQ ID NO: 3356 - DNA, 55 bp, Artificial Sequence
  Synthetic polynucleotide
gtgacgcctcaatactcgctactcgtacacgggtaataacctaggcgtttaatta

SEQ ID NO: 3357 - DNA, 55 bp, Artificial Sequence
  Synthetic polynucleotide
cgtctaaattgagtgccctaagatgtgatgaggagcaagatttcctcgttttgct

SEQ ID NO: 3358 - DNA, 55 bp, Artificial Sequence
  Synthetic polynucleotide
ggtatatctgttggctctaaaaggcaccaaggggtaatgcaaaagatgtcggttt

SEQ ID NO: 3359 - DNA, 55 bp, Artificial Sequence
  Synthetic polynucleotide
tcgtcaagcctgctctcgtccccgtaaaaccggcgcacattgttgttcagtacct

SEQ ID NO: 3360 - DNA, 55 bp, Artificial Sequence
  Synthetic polynucleotide
ggcaaattacgtcgctcacccggcttaaatcgggtaaagctcttctcggctggac

SEQ ID NO: 3361 - DNA, 55 bp, Artificial Sequence
  Synthetic polynucleotide
tgcagccctagtccctcgcatgtcctttcttggttgacccggcttgattatagcg

SEQ ID NO: 3362 - DNA, 55 bp, Artificial Sequence
  Synthetic polynucleotide
agttcccaataatccccggtggcaatcttgcggtcgcatcccgaacacctgcgtt

SEQ ID NO: 3363 - DNA, 55 bp, Artificial Sequence
  Synthetic polynucleotide
gcatggcgttccgctgcgccaagttgaatgaggctcggtaatagtgcaccggata

SEQ ID NO: 3364 - DNA, 55 bp, Artificial Sequence
  Synthetic polynucleotide
ctagacgttttgtcttcgtactggcttccggggcctcccgtgagggtttcttacc

SEQ ID NO: 3365 - DNA, 55 bp, Artificial Sequence
  Synthetic polynucleotide
acgtggccatttgtatctacgggtagccttcgggctaccagtactttcggtcaca

SEQ ID NO: 3366 - DNA, 55 bp, Artificial Sequence
  Synthetic polynucleotide
cgaacgaaccgacgctcaaatgggtactcgtggggccatcgttacgcaaatgcat

SEQ ID NO: 3367 - DNA, 55 bp, Artificial Sequence
  Synthetic polynucleotide
ctactaccacctatcacggcggaaacattacgggcgctgatcgttttgacatgtt

SEQ ID NO: 3368 - DNA, 55 bp, Artificial Sequence
  Synthetic polynucleotide
gagtgcattcagaacacactagtggctgttaggcttacgcgcactatagctccgc

SEQ ID NO: 3369 - DNA, 55 bp, Artificial Sequence
  Synthetic polynucleotide
atcatttcccctggagctaatatctgaggctggagcagctcggacatagggattc

SEQ ID NO: 3370 - DNA, 55 bp, Artificial Sequence
  Synthetic polynucleotide
ccaaggataaacggagccctcgtaggacgatggatcctcagacgtttaaccgcta

SEQ ID NO: 3371 - DNA, 55 bp, Artificial Sequence
  Synthetic polynucleotide
gcgcattggtagtctgcataggataggtgcaggtcatgttcacgtgtcttcagta

SEQ ID NO: 3372 - DNA, 55 bp, Artificial Sequence
  Synthetic polynucleotide
cgtctctaatgcaccccactgattgaccactggagcgatgtccgggtcggtcaga

SEQ ID NO: 3373 - DNA, 55 bp, Artificial Sequence
  Synthetic polynucleotide
aataaaattcggatcaccgagattcgaggagggtcggcccataacggtaacttgc

SEQ ID NO: 3374 - DNA, 55 bp, Artificial Sequence
  Synthetic polynucleotide
aactgctgtggctgagctgggcacacatttgggccgctgccgttatccgggggtc

SEQ ID NO: 3375 - DNA, 55 bp, Artificial Sequence
  Synthetic polynucleotide
tacgggccccgcactgcgactgctggaattaggacaccgacgccacgtctgggta

SEQ ID NO: 3376 - DNA, 55 bp, Artificial Sequence
  Synthetic polynucleotide
ccaggatttgccagcactgctagcgtttctaggcgacggggcaggaatcccctgc

SEQ ID NO: 3377 - DNA, 55 bp, Artificial Sequence
  Synthetic polynucleotide
gagcaagagtagctggcacacggcctctatcggcgcaggagactgagatgggcca

SEQ ID NO: 3378 - DNA, 55 bp, Artificial Sequence
  Synthetic polynucleotide
agagctatggcagctgccgtgctcatgcctcggggaattcgagctcatcctccgg

SEQ ID NO: 3379 - DNA, 55 bp, Artificial Sequence
  Synthetic polynucleotide
ttcctccctccttggccagccacgcgaactcggaatttcacttacacccgggccg

SEQ ID NO: 3380 - DNA, 55 bp, Artificial Sequence
  Synthetic polynucleotide
cgccccctgatattaccgcgcgcggacacaaggagcgaccagtaccaagaggtac

SEQ ID NO: 3381 - DNA, 55 bp, Artificial Sequence
  Synthetic polynucleotide
aggtcaacgccacgaccccacacgacgtcgtggttaatccccgtgccccagtttg

SEQ ID NO: 3382 - DNA, 55 bp, Artificial Sequence
  Synthetic polynucleotide
acgcggctgagacctcccttgcggtggagttggcagtcgacggcagacccgatgg

SEQ ID NO: 3383 - DNA, 55 bp, Artificial Sequence
  Synthetic polynucleotide
tgtggctgatcccgttcggagtgccctagtcggatggctgcaggacgacgtctca

SEQ ID NO: 3384 - DNA, 55 bp, Artificial Sequence
  Synthetic polynucleotide
ttgggcgtggcccatacctgagcgacggagaggcactcactatgccctgatacgc

SEQ ID NO: 3385 - DNA, 55 bp, Artificial Sequence
  Synthetic polynucleotide
aaaccctaattcgagccacaagcgtgactgagggccgtgccccaaactggcgccg

SEQ ID NO: 3386 - DNA, 55 bp, Artificial Sequence
  Synthetic polynucleotide
aagccgtggcctggtacttagcatgaaagcgggtcgcgttgtgcgcacgcgagcg

SEQ ID NO: 3387 - DNA, 55 bp, Artificial Sequence
  Synthetic polynucleotide
gtcagaacgaactccgcaagacctatgagacggcgtccctggagcgcgaaccacc

SEQ ID NO: 3388 - DNA, 55 bp, Artificial Sequence
  Synthetic polynucleotide
ccatttatcgcggtcccacgatagccaggttggttgccatcggccgcctccatcc

SEQ ID NO: 3389 - DNA, 55 bp, Artificial Sequence
  Synthetic polynucleotide
caagggttataaacgtcttagtagttatttaggaaagtcttggttatactattgc

SEQ ID NO: 3390 - DNA, 55 bp, Artificial Sequence
  Synthetic polynucleotide
gatcatttattggcttctgagtgtttaattgggttttaatatacgattattgagt

SEQ ID NO: 3391 - DNA, 55 bp, Artificial Sequence
  Synthetic polynucleotide
tggtattacagtataaccaattatttaattaggatatttacgacttacaaatttc

SEQ ID NO: 3392 - DNA, 55 bp, Artificial Sequence
  Synthetic polynucleotide
gattgatgtctaggatcttatacgattatccggatctatctctttttcattgttt

SEQ ID NO: 3393 - DNA, 55 bp, Artificial Sequence
  Synthetic polynucleotide
taagattaagcgagttcaaggagttaatagaggattaagtttaaactaatagtcg

SEQ ID NO: 3394 - DNA, 55 bp, Artificial Sequence
  Synthetic polynucleotide
cacttaggccagattgccaaaagaatataaaggcaatatcaggttctaatttttt

SEQ ID NO: 3395 - DNA, 55 bp, Artificial Sequence
  Synthetic polynucleotide
tttaactatgttcagtcggtttgatcgtattggtttatcaaggtacttgtaaatt

SEQ ID NO: 3396 - DNA, 55 bp, Artificial Sequence
  Synthetic polynucleotide
aacgactgtgatagttcaaatgtaatgttgtggagtaatagttttatcgtttcct

SEQ ID NO: 3397 - DNA, 55 bp, Artificial Sequence
  Synthetic polynucleotide
taaaatggcctaagtgcgccactaaaataaagggcaatctattaatgttattatc

SEQ ID NO: 3398 - DNA, 55 bp, Artificial Sequence
  Synthetic polynucleotide
gttcaatgcaagatgaccctatataaacaaaggataaatcgaaaataagtgatta

SEQ ID NO: 3399 - DNA, 55 bp, Artificial Sequence
  Synthetic polynucleotide
aaaaacacataagaaactacctcaagtaaaaggtctaaagttacgtttgttcagt

SEQ ID NO: 3400 - DNA, 55 bp, Artificial Sequence
  Synthetic polynucleotide
ttttaatactaggtcacgggagttgtgagagggtataatttttttaattatttac

SEQ ID NO: 3401 - DNA, 55 bp, Artificial Sequence
  Synthetic polynucleotide
gaatttagtaatgaaacggaactgatgtgtaggtgtgagtaacaattaattggat

SEQ ID NO: 3402 - DNA, 55 bp, Artificial Sequence
  Synthetic polynucleotide
cattaaaaatatgagccatgacaaaaccaatggccattaattaattggcaatgct

SEQ ID NO: 3403 - DNA, 55 bp, Artificial Sequence
  Synthetic polynucleotide
tcatagataacagtaccaagttaaaaacaaagggtaaatgggaggtttatgaatt

SEQ ID NO: 3404 - DNA, 55 bp, Artificial Sequence
  Synthetic polynucleotide
cttacttaactcatggccgttataattatttggattagcgccccttttacggaac

SEQ ID NO: 3405 - DNA, 55 bp, Artificial Sequence
  Synthetic polynucleotide
cttgggggcttcattgccatcaaaataaatcgggagtaacttataaatttatctt

SEQ ID NO: 3406 - DNA, 55 bp, Artificial Sequence
  Synthetic polynucleotide
cttgttctattgtcatcgttgtcgttatttcgggtttcaacacgccaaacttgtt

SEQ ID NO: 3407 - DNA, 55 bp, Artificial Sequence
  Synthetic polynucleotide
aagcatgatgtaaggcctgttgaagatttaaggagatggattactgagagatcgt

SEQ ID NO: 3408 - DNA, 55 bp, Artificial Sequence
  Synthetic polynucleotide
aactatcatgacaaaccgagggctataatcagggaccacgtaaaagaatgattgt

SEQ ID NO: 3409 - DNA, 55 bp, Artificial Sequence
  Synthetic polynucleotide
gcattaagttgatgatctcggggagatattgggcatgcacattattagagaattt

SEQ ID NO: 3410 - DNA, 55 bp, Artificial Sequence
  Synthetic polynucleotide
ttcaacgcgactacgtcctaaaatcaaaaaaggcaccattgtcctaccaatcaat

SEQ ID NO: 3411 - DNA, 55 bp, Artificial Sequence
  Synthetic polynucleotide
ggttccaaaaaactaactggagggagtactaggtaatctattggtaaccacatct

SEQ ID NO: 3412 - DNA, 55 bp, Artificial Sequence
  Synthetic polynucleotide
caaacagggtaatttcctgcacccaaaaaaaggcgtttccttttacaaaaactgc

SEQ ID NO: 3413 - DNA, 55 bp, Artificial Sequence
  Synthetic polynucleotide
tttctacctggtttccctgaactcgtatgacggaactatcaacctttcgttattt

SEQ ID NO: 3414 - DNA, 55 bp, Artificial Sequence
  Synthetic polynucleotide
tactaggagaggtttacgatagcccgtactcgggagtttgaaaatttatagttga

SEQ ID NO: 3415 - DNA, 55 bp, Artificial Sequence
  Synthetic polynucleotide
tcttctcgaattgctgctagtgatcaggctgggatagtatgtgataaaaaacgtt

SEQ ID NO: 3416 - DNA, 55 bp, Artificial Sequence
  Synthetic polynucleotide
tgaaaggaaaagatcacaaagaaagtcaggcggacgatattaaaaactagagaca

SEQ ID NO: 3417 - DNA, 55 bp, Artificial Sequence
  Synthetic polynucleotide
gtgttgttagtacgcactagtacaattggttgggtacacggtaataacgtaaaag

SEQ ID NO: 3418 - DNA, 55 bp, Artificial Sequence
  Synthetic polynucleotide
tttcaactggagtactcagagctacggaactggtcagttatatctcttatttcga

SEQ ID NO: 3419 - DNA, 55 bp, Artificial Sequence
  Synthetic polynucleotide
tgacatttgtaccaaacctcttgctatttatgggctccttactacgcctaacctg

SEQ ID NO: 3420 - DNA, 55 bp, Artificial Sequence
  Synthetic polynucleotide
ccagtatgatatcctacgcagggagtttctgggttaagagcgattagttcacttt

SEQ ID NO: 3421 - DNA, 55 bp, Artificial Sequence
  Synthetic polynucleotide
cttatcaacccacttcctcttagaccttctaggtacacgactgctaagaatcctc

SEQ ID NO: 3422 - DNA, 55 bp, Artificial Sequence
  Synthetic polynucleotide
ccgtatatgcaacgctctaggaaaataaaaaggacgagagagacgggctattaag

SEQ ID NO: 3423 - DNA, 55 bp, Artificial Sequence
  Synthetic polynucleotide
catactgaagattccgcacactgcaattcctggataggctagacaaccatcaagt

SEQ ID NO: 3424 - DNA, 55 bp, Artificial Sequence
  Synthetic polynucleotide
cagtaactagtacgctctggtttatgcttggggcagtttgatagtatccacaaat

SEQ ID NO: 3425 - DNA, 55 bp, Artificial Sequence
  Synthetic polynucleotide
gtacaagaatttggttctattgtctgctgttggtcaccatcgttcgacatacgtt

SEQ ID NO: 3426 - DNA, 55 bp, Artificial Sequence
  Synthetic polynucleotide
tgtattgcttaaaagacttgcgcgctgctcgggaaaattgttttagtcggcaagg

SEQ ID NO: 3427 - DNA, 55 bp, Artificial Sequence
  Synthetic polynucleotide
ctgtatatgttctacactgatgctggtcgtaggaaagggtatggactatatacag

SEQ ID NO: 3428 - DNA, 55 bp, Artificial Sequence
  Synthetic polynucleotide
tacaagggcaggagaactcaagcatgacatagggaaccaaaccggtgatttaagt

SEQ ID NO: 3429 - DNA, 55 bp, Artificial Sequence
  Synthetic polynucleotide
tctcatttaacaagtgcgttaaggatcggtcgggacgctgttgatttacaactcg

SEQ ID NO: 3430 - DNA, 55 bp, Artificial Sequence
  Synthetic polynucleotide
tacttcctaaattacacctcctacggtaacaggtcacttccctacgctgaatgct

SEQ ID NO: 3431 - DNA, 55 bp, Artificial Sequence
  Synthetic polynucleotide
aaaaaacaaggagtgccagagacacggtggtggttaagtaaggcttctaagttct

SEQ ID NO: 3432 - DNA, 55 bp, Artificial Sequence
  Synthetic polynucleotide
gtaacctaaagatgaccgagtctacggtgcaggcgagctttgtagttatgttaac

SEQ ID NO: 3433 - DNA, 55 bp, Artificial Sequence
  Synthetic polynucleotide
ataccgggtactgaagcactaaggttcagctggatccttacaaggcatattaaca

SEQ ID NO: 3434 - DNA, 55 bp, Artificial Sequence
  Synthetic polynucleotide
atagaggggtaaatagcgtcccttatttccggggcgctgatactcctaaagcaaa

SEQ ID NO: 3435 - DNA, 55 bp, Artificial Sequence
  Synthetic polynucleotide
tccttttaccagtgggcggggagtgcctctaggagcttatcacgctgacaagtga

SEQ ID NO: 3436 - DNA, 55 bp, Artificial Sequence
  Synthetic polynucleotide
gaccgtcgggttcagtcgtatgtggtaattgggcctgccagagcacgtgaacaaa

SEQ ID NO: 3437 - DNA, 55 bp, Artificial Sequence
  Synthetic polynucleotide
gcacgtgaccccaatgcgtttggccgggtgtggtatcgtcagactccgtcagtaa

SEQ ID NO: 3438 - DNA, 55 bp, Artificial Sequence
  Synthetic polynucleotide
cctgtttagggttctgcatgtatggcctttgggagcgagccacgtaagagcatat

SEQ ID NO: 3439 - DNA, 55 bp, Artificial Sequence
  Synthetic polynucleotide
agcaccgagtctcgaccgcttcaggtgtttaggagagcgataccacgacgggcga

SEQ ID NO: 3440 - DNA, 55 bp, Artificial Sequence
  Synthetic polynucleotide
ctgttgggctcatgttcaccgttcgggccaaggattagtctaccttcgcattacg

SEQ ID NO: 3441 - DNA, 55 bp, Artificial Sequence
  Synthetic polynucleotide
gaataagccttcacggccggccaactaccagggagtaacctctaagtacggggat

SEQ ID NO: 3442 - DNA, 55 bp, Artificial Sequence
  Synthetic polynucleotide
tatacgtgacagggcacctgggccattgtcgggaacatcagtttaaacggacaac

SEQ ID NO: 3443 - DNA, 55 bp, Artificial Sequence
  Synthetic polynucleotide
cgtttaggttcagacccatccggagcagtggggtgacgcactaccatagatcgcc

SEQ ID NO: 3444 - DNA, 55 bp, Artificial Sequence
  Synthetic polynucleotide
tcccgataggaccacccgaccgcacttcgaaggcttgtacaatagcagtggagag

SEQ ID NO: 3445 - DNA, 55 bp, Artificial Sequence
  Synthetic polynucleotide
cggtagggtctgagggcatgatatggacacgggccctgcgccatatttgcttacc

SEQ ID NO: 3446 - DNA, 55 bp, Artificial Sequence
  Synthetic polynucleotide
gcttgaccggagataaccgtggataaaggctgggggcggaaaccaccgacatcgg

SEQ ID NO: 3447 - DNA, 55 bp, Artificial Sequence
  Synthetic polynucleotide
tttccattgtaaattgctgatgaccctggccggggtcaagtgagtccaaacccct

SEQ ID NO: 3448 - DNA, 55 bp, Artificial Sequence
  Synthetic polynucleotide
tttcatggctcaaacacggttacggacgagaggatggaagactaattgagccagg

SEQ ID NO: 3449 - DNA, 55 bp, Artificial Sequence
  Synthetic polynucleotide
ggcctaccacgcgcgacagcctatgcttctgggattcgctatcctgtgcgacggt

SEQ ID NO: 3450 - DNA, 55 bp, Artificial Sequence
  Synthetic polynucleotide
ctacggggctggagtccgggacccctttcagggaacagtcgcgttcgggccggat

SEQ ID NO: 3451 - DNA, 55 bp, Artificial Sequence
  Synthetic polynucleotide
ggcgtcggagtaaacgcgctccagtatttccggcgacagcatgctgccccagcgc

SEQ ID NO: 3452 - DNA, 55 bp, Artificial Sequence
  Synthetic polynucleotide
ccctctcgtcccacttcccattggtttgtctggggcggtcacctcgcgggtgcac

SEQ ID NO: 3453 - DNA, 55 bp, Artificial Sequence
  Synthetic polynucleotide
gcatgagtgtcacgtccatgcttggcacctcggacgtcggaagacggcgcagtct

SEQ ID NO: 3454 - DNA, 55 bp, Artificial Sequence
  Synthetic polynucleotide
caaagatatccctagtcagcacggttaacgtgggggcgttcgcccgcccgggaac

SEQ ID NO: 3455 - DNA, 55 bp, Artificial Sequence
  Synthetic polynucleotide
gcccagcgacagctcacacgctgctaccggcggtatacttcccaccggatgtccc

SEQ ID NO: 3456 - DNA, 55 bp, Artificial Sequence
  Synthetic polynucleotide
atctttcgtgccacagcgttggtgtccccggggccgaaacgagcccacgacacat

SEQ ID NO: 3457 - DNA, 55 bp, Artificial Sequence
  Synthetic polynucleotide
gctggtcagcgactacctacggagggataaaggcccccccgtaccggtatgctga

SEQ ID NO: 3458 - DNA, 55 bp, Artificial Sequence
  Synthetic polynucleotide
tctccactgtcgccgcccccggtacccgagtggccgtttcgatgttcagtggtat

SEQ ID NO: 3459 - DNA, 55 bp, Artificial Sequence
  Synthetic polynucleotide
tcgacgtcagtgtgcgcgttactggaagggtggttcccccacctcccggtccgtc

SEQ ID NO: 3460 - DNA, 55 bp, Artificial Sequence
  Synthetic polynucleotide
aacccagcgagccgcgcgattcttaccagcgggaggttccgtccgttgcgccaac

SEQ ID NO: 3461 - DNA, 55 bp, Artificial Sequence
  Synthetic polynucleotide
cgctggctacctattccggaggaacagggtgggaatttccggttgcggtgggcca

SEQ ID NO: 3462 - DNA, 55 bp, Artificial Sequence
  Synthetic polynucleotide
acggcagtaacaagcgctgtgtatgaacgcgggtgatccctagcgcgacggctcg

SEQ ID NO: 3463 - DNA, 55 bp, Artificial Sequence
  Synthetic polynucleotide
ccggcaggcgtaaaccctaggcctcgacaccggagtcgattctgctaggctggga

SEQ ID NO: 3464 - DNA, 55 bp, Artificial Sequence
  Synthetic polynucleotide
ccatgatcattactagcttattcttaatttaggtagtagcattacaatcttctcg

SEQ ID NO: 3465 - DNA, 55 bp, Artificial Sequence
  Synthetic polynucleotide
tatcctggagtctgacctattaattatttctggtctaatttgtgcttagatcttt

SEQ ID NO: 3466 - DNA, 55 bp, Artificial Sequence
  Synthetic polynucleotide
tgtagcatcagattctccacaaaagtttctaggacagaaaagattaagttttttg

SEQ ID NO: 3467 - DNA, 55 bp, Artificial Sequence
  Synthetic polynucleotide
aacacttataatcattcctttgtcatgatttggagattttgggtgtagtctattc

SEQ ID NO: 3468 - DNA, 55 bp, Artificial Sequence
  Synthetic polynucleotide
ttacatgccgcttaatccactatattaaaccggtattctacattaactatatcaa

SEQ ID NO: 3469 - DNA, 55 bp, Artificial Sequence
  Synthetic polynucleotide
tctttagaaaaatttgcattggtttcaattaggaaattcatacagcaccggtcta

SEQ ID NO: 3470 - DNA, 55 bp, Artificial Sequence
  Synthetic polynucleotide
agagtagactatattacgaaagtgaagaataggagtaaagagctaatgaaacaaa

SEQ ID NO: 3471 - DNA, 55 bp, Artificial Sequence
  Synthetic polynucleotide
tcctcgcaataaaaatcacaagtaaaatacgggaaactgaaaagtattaatcaat

SEQ ID NO: 3472 - DNA, 55 bp, Artificial Sequence
  Synthetic polynucleotide
caacctgagtcaacttcttctttctctgttaggatctttttcataacagaatata

SEQ ID NO: 3473 - DNA, 55 bp, Artificial Sequence
  Synthetic polynucleotide
gagtttaaattaaagacggaacatatgaaaaggagttatgtctacactggaactt

SEQ ID NO: 3474 - DNA, 55 bp, Artificial Sequence
  Synthetic polynucleotide
ttactcttattaagagctataaaaaatggtcggaatataaaaattaaaccattca

SEQ ID NO: 3475 - DNA, 55 bp, Artificial Sequence
  Synthetic polynucleotide
ctatattgtagagtatcagatattaatcattggggctattattaagatatatggg

SEQ ID NO: 3476 - DNA, 55 bp, Artificial Sequence
  Synthetic polynucleotide
agtatattcacagcggcaagataacaacataggacattaaaattctatttcaaac

SEQ ID NO: 3477 - DNA, 55 bp, Artificial Sequence
  Synthetic polynucleotide
atataggctgcaatgccaatagagatgtgaaggcattacttttagaatatgaatt

SEQ ID NO: 3478 - DNA, 55 bp, Artificial Sequence
  Synthetic polynucleotide
aaacaaatgagaatcacagaaggacgaagctgggagataaattaattgtttatta

SEQ ID NO: 3479 - DNA, 55 bp, Artificial Sequence
  Synthetic polynucleotide
cattaccctctgttccctcttactattcctgggctgtagttaattaacatgaaac

SEQ ID NO: 3480 - DNA, 55 bp, Artificial Sequence
  Synthetic polynucleotide
ggaaccatctttaattctctgacccttatttggactcttcaactgcgaattttgg

SEQ ID NO: 3481 - DNA, 55 bp, Artificial Sequence
  Synthetic polynucleotide
gacaccaatagagtcgctatttggataattaggttgttgttggattggtagagga

SEQ ID NO: 3482 - DNA, 55 bp, Artificial Sequence
  Synthetic polynucleotide
catatgtggttctaagctcaaacaaaattccgggacaaggattacaaaacaatgt

SEQ ID NO: 3483 - DNA, 55 bp, Artificial Sequence
  Synthetic polynucleotide
taactgtcgaattcggcatttgtcattgtttggttgaagatcacatctatggcct

SEQ ID NO: 3484 - DNA, 55 bp, Artificial Sequence
  Synthetic polynucleotide
aaggcgttgcgccatgcgatcaatttagcttggttgttatttcaccgaataaatt

SEQ ID NO: 3485 - DNA, 55 bp, Artificial Sequence
  Synthetic polynucleotide
aaaactatgcatgttccgaccagcttcctctggacgctgtttatacttataagaa

SEQ ID NO: 3486 - DNA, 55 bp, Artificial Sequence
  Synthetic polynucleotide
agaattttttaggattctccattgatgattcgggagggaggacattaaagtgttg

SEQ ID NO: 3487 - DNA, 55 bp, Artificial Sequence
  Synthetic polynucleotide
tcagaaaaactgggtaccaaaagcaagaaacggataaccaaatttgcagattttg

SEQ ID NO: 3488 - DNA, 55 bp, Artificial Sequence
  Synthetic polynucleotide
atatacctaaaatcaacgatggtatcgaagtggggtttatgtatgggaacataag

SEQ ID NO: 3489 - DNA, 55 bp, Artificial Sequence
  Synthetic polynucleotide
ttgaactcgagctgttctcggtataatcgtgggagctctcttctattaattgtat

SEQ ID NO: 3490 - DNA, 55 bp, Artificial Sequence
  Synthetic polynucleotide
gataattggaaccatactactggtaaccaaaggcaaaactatatggtaggcgcat

SEQ ID NO: 3491 - DNA, 55 bp, Artificial Sequence
  Synthetic polynucleotide
attgtagatataggagccatggtagtacgctgggttgagaagcgataaaaaactt

SEQ ID NO: 3492 - DNA, 55 bp, Artificial Sequence
  Synthetic polynucleotide
gttaatctgacacgatcccatctacaacgctggacagtagattaaagtttacaat

SEQ ID NO: 3493 - DNA, 55 bp, Artificial Sequence
  Synthetic polynucleotide
ggtcaaaaggatgtgtcaacggaaacgtgatggtagtgaaaactctctatttaca

SEQ ID NO: 3494 - DNA, 55 bp, Artificial Sequence
  Synthetic polynucleotide
tatatcagtaataccgccctgttcctttcacgggatgttcttacctagctcttac

SEQ ID NO: 3495 - DNA, 55 bp, Artificial Sequence
  Synthetic polynucleotide
cttaatttctatgccacgccatatataattcgggcccagacacgcgccaagatat

SEQ ID NO: 3496 - DNA, 55 bp, Artificial Sequence
  Synthetic polynucleotide
gttatgctggatggatctgtgagtgttactgggaactcacttggactggttatat

SEQ ID NO: 3497 - DNA, 55 bp, Artificial Sequence
  Synthetic polynucleotide
ataattctggtaggacctctcatgttatcgggggctggactgtaatccgaagtat

SEQ ID NO: 3498 - DNA, 55 bp, Artificial Sequence
  Synthetic polynucleotide
aaagcgaatggttaagcttgtggaaataaaaggcgcagacgtgaaaacctcctgg

SEQ ID NO: 3499 - DNA, 55 bp, Artificial Sequence
  Synthetic polynucleotide
cgtactggttattaaccaagtggtaaattagggtgtccaaggcgtttctacacca

SEQ ID NO: 3500 - DNA, 55 bp, Artificial Sequence
  Synthetic polynucleotide
gaacacataaggatggctgcaagagtgtcatgggagaacagcgataaataatccg

SEQ ID NO: 3501 - DNA, 55 bp, Artificial Sequence
  Synthetic polynucleotide
aacgataaaccagggcctactcaacgaaatgggaatctcaccgtcactgaacttt

SEQ ID NO: 3502 - DNA, 55 bp, Artificial Sequence
  Synthetic polynucleotide
cttagttataacccgtcacgcgggcgattaaggaacgtgcctctcaacatattaa

SEQ ID NO: 3503 - DNA, 55 bp, Artificial Sequence
  Synthetic polynucleotide
cacagatacggttgctccagggagcgatataggaatttaccagaggtcatttcta

SEQ ID NO: 3504 - DNA, 55 bp, Artificial Sequence
  Synthetic polynucleotide
gtagtttctagggtacccattaccatgatctggcaatcgtacagattgtgcagta

SEQ ID NO: 3505 - DNA, 55 bp, Artificial Sequence
  Synthetic polynucleotide
tgttgatcgatagggacgatctgttgtaagaggtcgacttggtctgtaatacacc

SEQ ID NO: 3506 - DNA, 55 bp, Artificial Sequence
  Synthetic polynucleotide
gttgctagactataggcaacaaaccgacacaggtataatgaagacgccgaggatt

SEQ ID NO: 3507 - DNA, 55 bp, Artificial Sequence
  Synthetic polynucleotide
gaggatctaagagagacccgaataacccgtcggacgaaaataaatacgtttcctg

SEQ ID NO: 3508 - DNA, 55 bp, Artificial Sequence
  Synthetic polynucleotide
agttgcaagaccgggtcagttgaaaaacggaggaagtccaatcattttgtgtata

SEQ ID NO: 3509 - DNA, 55 bp, Artificial Sequence
  Synthetic polynucleotide
tgtgtcggcgggtttgcgctcaaatagtttgggctggtcatcacagatcagacgc

SEQ ID NO: 3510 - DNA, 55 bp, Artificial Sequence
  Synthetic polynucleotide
gaaatcaaccccctaccccttggctttctccggtagttacgctagcgtcaccagc

SEQ ID NO: 3511 - DNA, 55 bp, Artificial Sequence
  Synthetic polynucleotide
tggctgcacttcgtacccgtaacgccttctcgggtgaatacttgcagctgaatag

SEQ ID NO: 3512 - DNA, 55 bp, Artificial Sequence
  Synthetic polynucleotide
cgcggtgtagtttgaccgaaccagaattaatggccggccgacgaagtacgattgc

SEQ ID NO: 3513 - DNA, 55 bp, Artificial Sequence
  Synthetic polynucleotide
cccttcccggagccctcctgattgagatcttggctgatactttgcctagttgacc

SEQ ID NO: 3514 - DNA, 55 bp, Artificial Sequence
  Synthetic polynucleotide
acagtctatgaaacggccccgaggcattatcggtgttggcggatcaggaatacct

SEQ ID NO: 3515 - DNA, 55 bp, Artificial Sequence
  Synthetic polynucleotide
tcatctatcgagaatgccgcctccatcttatggctcgggatgttcgtccacgaac

SEQ ID NO: 3516 - DNA, 55 bp, Artificial Sequence
  Synthetic polynucleotide
ccagaatgacgttcgtcactacagctccctgggtaaatctcccagcgtcgacgaa

SEQ ID NO: 3517 - DNA, 55 bp, Artificial Sequence
  Synthetic polynucleotide
agctaaaattaccggtcgcaggctcgagttgggtacaggtctgatccgctggccc

SEQ ID NO: 3518 - DNA, 55 bp, Artificial Sequence
  Synthetic polynucleotide
atgtattgcaacctatcgcctccacgtgaatggccccgaagagcaggatgaaatt

SEQ ID NO: 3519 - DNA, 55 bp, Artificial Sequence
  Synthetic polynucleotide
tatattcctcagccgtcagaaggtttccaccggggaccgagcagatgaccttttt

SEQ ID NO: 3520 - DNA, 55 bp, Artificial Sequence
  Synthetic polynucleotide
attgctatgatactggcttagagagtcaaagggcgcgttgagccgaatcagtcga

SEQ ID NO: 3521 - DNA, 55 bp, Artificial Sequence
  Synthetic polynucleotide
tcaaacattagtcggccgaaactgacaggtcgggaacttagtcacgaccgttcca

SEQ ID NO: 3522 - DNA, 55 bp, Artificial Sequence
  Synthetic polynucleotide
gtccaaacaacacgctcagattcagaccaaagggctacgggcttgagccgagacg

SEQ ID NO: 3523 - DNA, 55 bp, Artificial Sequence
  Synthetic polynucleotide
ttcagcataagcgactcgcaagaactgggccggcggtctgtcagtcctgcggaaa

SEQ ID NO: 3524 - DNA, 55 bp, Artificial Sequence
  Synthetic polynucleotide
agtacgaggctatgggctcccgcgtcttcagggagacagccggggaagtaagccc

SEQ ID NO: 3525 - DNA, 55 bp, Artificial Sequence
  Synthetic polynucleotide
gcggtccccccggcctcggcgagagtttattgggcgtcaaagtcggttcccgtta

SEQ ID NO: 3526 - DNA, 55 bp, Artificial Sequence
  Synthetic polynucleotide
aggacggatcgccccgccgctggcggccttaggaccttatcatgccctgtcggca

SEQ ID NO: 3527 - DNA, 55 bp, Artificial Sequence
  Synthetic polynucleotide
gcggggctggaaccgtccttctagtaggtttggtgggtaccggccctgagctatc

SEQ ID NO: 3528 - DNA, 55 bp, Artificial Sequence
  Synthetic polynucleotide
ccgagccgcggcgatgccgttccgcctactcggtaacggcaaggaacactaggat

SEQ ID NO: 3529 - DNA, 55 bp, Artificial Sequence
  Synthetic polynucleotide
ggaccgcacagcgcgcctcgctttgctctccggagaatagtgaagcgacctccag

SEQ ID NO: 3530 - DNA, 55 bp, Artificial Sequence
  Synthetic polynucleotide
accccgtcaagtgatcctgccctcgtctacggggtgacgatccatactgccccgg

SEQ ID NO: 3531 - DNA, 55 bp, Artificial Sequence
  Synthetic polynucleotide
gcatcccgcagagcggcgcaccgaaagaatcgggtattcagctggcctggattcc

SEQ ID NO: 3532 - DNA, 55 bp, Artificial Sequence
  Synthetic polynucleotide
cgttctaagtctaacgctgagtatgtggcgggggggtagcgggtccggcgcacca

SEQ ID NO: 3533 - DNA, 55 bp, Artificial Sequence
  Synthetic polynucleotide
ggctgtgaccgcacctcgcgctaaccaagatggcacaccccgtctggcgggggcc

SEQ ID NO: 3534 - DNA, 55 bp, Artificial Sequence
  Synthetic polynucleotide
cgctgtgccgacgatccatgcgatagctgtcgggcatggctaaggggagaagggt

SEQ ID NO: 3535 - DNA, 55 bp, Artificial Sequence
  Synthetic polynucleotide
agacgcgctacaaccgcggctacatatgtccggacgggccctaagccctgccctt

SEQ ID NO: 3536 - DNA, 55 bp, Artificial Sequence
  Synthetic polynucleotide
cctgcgacaggtgaccctctaagttgcgacgggtcagccatggcagcgaagtacc

SEQ ID NO: 3537 - DNA, 55 bp, Artificial Sequence
  Synthetic polynucleotide
ttcagtctcaagcgtgcccgaaatccgggagggcggggcagctcggcgttctttt

SEQ ID NO: 3538 - DNA, 55 bp, Artificial Sequence
  Synthetic polynucleotide
tgtggggaccctggcccacatactcccggcgggaagtttgctcctgtgtccaacg

SEQ ID NO: 3539 - DNA, 55 bp, Artificial Sequence
  Synthetic polynucleotide
caaagggtgtataaaactatttatttaaaagggtaaaattcatcaagcgctagat

SEQ ID NO: 3540 - DNA, 55 bp, Artificial Sequence
  Synthetic polynucleotide
ggaggaatttatttctcttacgtctaatataggattctcactgtacactaatttg

SEQ ID NO: 3541 - DNA, 55 bp, Artificial Sequence
  Synthetic polynucleotide
gaaaagttgtcccattcacatactataaattggcccttctatatacaatatgtta

SEQ ID NO: 3542 - DNA, 55 bp, Artificial Sequence
  Synthetic polynucleotide
atttttcttactagctcatcattgttcttaaggtagtcttctctctcatgtactt

SEQ ID NO: 3543 - DNA, 55 bp, Artificial Sequence
  Synthetic polynucleotide
atgctgaagaatttagcctgtgtaaaattggggtccacaaaacaaaaaaattttt

SEQ ID NO: 3544 - DNA, 55 bp, Artificial Sequence
  Synthetic polynucleotide
gattttgtcaagaattctgttgtgaaattaaggattaagaagatgtggaaactca

SEQ ID NO: 3545 - DNA, 55 bp, Artificial Sequence
  Synthetic polynucleotide
tgttatctacagtcagctagcaagaaaaacaggtttataaagggaacatagaaat

SEQ ID NO: 3546 - DNA, 55 bp, Artificial Sequence
  Synthetic polynucleotide
cgtattgttggtaggactttattaataagaaggtacatatctttaaaataccatt

SEQ ID NO: 3547 - DNA, 55 bp, Artificial Sequence
  Synthetic polynucleotide
agtcatatctaaaacaccacacagtcaaaaaggtacataaaacacttcatctttg

SEQ ID NO: 3548 - DNA, 55 bp, Artificial Sequence
  Synthetic polynucleotide
aaataatcgggaagatcgaaatataaaccggggatagagaataatacacaaagtt

SEQ ID NO: 3549 - DNA, 55 bp, Artificial Sequence
  Synthetic polynucleotide
attgtcacgtaagtcccattagaattagtcgggaaaagtcaaaaattaaaattgc

SEQ ID NO: 3550 - DNA, 55 bp, Artificial Sequence
  Synthetic polynucleotide
acatctgtgttatatacactgtataatgttagggttatacattaaatcatttaag

SEQ ID NO: 3551 - DNA, 55 bp, Artificial Sequence
  Synthetic polynucleotide
tactattctgcacatgctgataataaaggacggcaacatgcttcataaaaattat

SEQ ID NO: 3552 - DNA, 55 bp, Artificial Sequence
  Synthetic polynucleotide
tagctagcagattcgtcaaaaatacctagaaggtaagaaaaaatatactatacgc

SEQ ID NO: 3553 - DNA, 55 bp, Artificial Sequence
  Synthetic polynucleotide
gtaatacaaaatttgacaaaacatatcagatggtaatagaaaaaaaacataatct

SEQ ID NO: 3554 - DNA, 55 bp, Artificial Sequence
  Synthetic polynucleotide
gtgtggctttctctcacgtttaaagttgcttggtcaattctcttttgtgttaata

SEQ ID NO: 3555 - DNA, 55 bp, Artificial Sequence
  Synthetic polynucleotide
aactacaaggcctatacggttgtaatatctaggatccggtgtaaccctctaaaaa

SEQ ID NO: 3556 - DNA, 55 bp, Artificial Sequence
  Synthetic polynucleotide
ttctctattctcgtcgcgcatgtttgttctcggattatttggttgaatccatata

SEQ ID NO: 3557 - DNA, 55 bp, Artificial Sequence
  Synthetic polynucleotide
ttcttaaaacggttagcaacaccataaatgcggaaacgcaatgacacattgaata

SEQ ID NO: 3558 - DNA, 55 bp, Artificial Sequence
  Synthetic polynucleotide
aaacaccataaaagaacagtcgagataaaaagggttatggactcagttcacgtcg

SEQ ID NO: 3559 - DNA, 55 bp, Artificial Sequence
  Synthetic polynucleotide
ttcagaatttctgattcggagaattaaaaaggggtttcgattcaagtcagtggag

SEQ ID NO: 3560 - DNA, 55 bp, Artificial Sequence
  Synthetic polynucleotide
tgcaaaattcaggttgcacagtgttagaattgggtcttcgctccagttttataga

SEQ ID NO: 3561 - DNA, 55 bp, Artificial Sequence
  Synthetic polynucleotide
ttgcgggtgaggtttgccctaaatacgttatggtagcccaataaaaaaaacaaga

SEQ ID NO: 3562 - DNA, 55 bp, Artificial Sequence
  Synthetic polynucleotide
taataacctgggacgactatcatccatcttgggatggtaacattcacactttttg

SEQ ID NO: 3563 - DNA, 55 bp, Artificial Sequence
  Synthetic polynucleotide
taaaacgcatgggagactgacgttatcgattggaagattgttaagacgcatattg

SEQ ID NO: 3564 - DNA, 55 bp, Artificial Sequence
  Synthetic polynucleotide
cgtacgcagcaagagccaactcgtaatgagaggttccaatttctaaactaataat

SEQ ID NO: 3565 - DNA, 55 bp, Artificial Sequence
  Synthetic polynucleotide
agattagctagtgatgcatgacaatcatagcggcgtacacataatttcacgtata

SEQ ID NO: 3566 - DNA, 55 bp, Artificial Sequence
  Synthetic polynucleotide
gtgtattctagaaggtccctctcactccgaaggcctacaaatttaatctttatac

SEQ ID NO: 3567 - DNA, 55 bp, Artificial Sequence
  Synthetic polynucleotide
ttaacaggttttgggaccagattatcatggtggagggaaacagaatcataaatcg

SEQ ID NO: 3568 - DNA, 55 bp, Artificial Sequence
  Synthetic polynucleotide
taatttaagggaagatcagtcttccagaggtggagacattataggaacagatgat

SEQ ID NO: 3569 - DNA, 55 bp, Artificial Sequence
  Synthetic polynucleotide
gttagtttactgggcgcttattgcctttataggttcgctccgttaaccaaatgtg

SEQ ID NO: 3570 - DNA, 55 bp, Artificial Sequence
  Synthetic polynucleotide
ggttagttacaccgcccgcgctagtattctgggcagccgttattataatactttt

SEQ ID NO: 3571 - DNA, 55 bp, Artificial Sequence
  Synthetic polynucleotide
ttttaggcacgtcttaccgttctatatttagggaatcgtcgtaggcgctcacagt

SEQ ID NO: 3572 - DNA, 55 bp, Artificial Sequence
  Synthetic polynucleotide
ctattcttataggcctcattgtacctctttagggtgcagccctactcgaatcaag

SEQ ID NO: 3573 - DNA, 55 bp, Artificial Sequence
  Synthetic polynucleotide
atgtcagatttgcaaacggtgtaagattatggggctgggcgcctaaaagttcttg

SEQ ID NO: 3574 - DNA, 55 bp, Artificial Sequence
  Synthetic polynucleotide
cgtttacagcaaaaggctaaattcataacaagggcacactaaacgattcggtcag

SEQ ID NO: 3575 - DNA, 55 bp, Artificial Sequence
  Synthetic polynucleotide
gatgcggggattgtatcgcaaacaaaagaggggtacactaaattacatgtcccaa

SEQ ID NO: 3576 - DNA, 55 bp, Artificial Sequence
  Synthetic polynucleotide
tcaaacaattatcccacgtttgatctgttagggaccccgtgcatgaccgtactat

SEQ ID NO: 3577 - DNA, 55 bp, Artificial Sequence
  Synthetic polynucleotide
ggaaagatgttttccaccaagtagtgaatcgggtcgactcaaggtcagtgaattg

SEQ ID NO: 3578 - DNA, 55 bp, Artificial Sequence
  Synthetic polynucleotide
gcttataaaggagagaccaatctctcagaggggagagctaaatcaatcacaatac

SEQ ID NO: 3579 - DNA, 55 bp, Artificial Sequence
  Synthetic polynucleotide
ttatccagtttggtttcttgcaaacagcccgggaccaatgcagttgaacatttcc

SEQ ID NO: 3580 - DNA, 55 bp, Artificial Sequence
  Synthetic polynucleotide
tcggcggttttaagacctgcatcgattggggggagtaagtattctgtacaatatg

SEQ ID NO: 3581 - DNA, 55 bp, Artificial Sequence
  Synthetic polynucleotide
cagaaccgcgaaatagctaatgggttccgcaggaagagtgttgtaaattagagtc

SEQ ID NO: 3582 - DNA, 55 bp, Artificial Sequence
  Synthetic polynucleotide
tagcaaaatagtagaacggtacgaccgagggggttgtagcagcgttaaacattca

SEQ ID NO: 3583 - DNA, 55 bp, Artificial Sequence
  Synthetic polynucleotide
ggaaatgtttgagggtccaatgaatcgaggagggtgtcttttattccgattaggc

SEQ ID NO: 3584 - DNA, 55 bp, Artificial Sequence
  Synthetic polynucleotide
ggtttctttggggtcaccctctagttatatggggtgccgttgtttcatgggtgca

SEQ ID NO: 3585 - DNA, 55 bp, Artificial Sequence
  Synthetic polynucleotide
gaatacctgcagtgggctttggccgattctaggaggtaggagttcgatgaatatg

SEQ ID NO: 3586 - DNA, 55 bp, Artificial Sequence
  Synthetic polynucleotide
ggcacactccgcttctctgtttctctcttttggggtcgccgctcttcagtaggcg

SEQ ID NO: 3587 - DNA, 55 bp, Artificial Sequence
  Synthetic polynucleotide
ctataattcaggtaccctgtcagactttagtggccccctagcttacgcgccaggg

SEQ ID NO: 3588 - DNA, 55 bp, Artificial Sequence
  Synthetic polynucleotide
tactcttctatggtgtcggtgttcttcttaaggctggggggtcacccttggcgag

SEQ ID NO: 3589 - DNA, 55 bp, Artificial Sequence
  Synthetic polynucleotide
gaccgcgcagatcggtctcagagatttaatcggacgaattgaaacagcacgatcc

SEQ ID NO: 3590 - DNA, 55 bp, Artificial Sequence
  Synthetic polynucleotide
cttatagatggcccgccgaccctgatcctacggctatataccaaagtgaatcaat

SEQ ID NO: 3591 - DNA, 55 bp, Artificial Sequence
  Synthetic polynucleotide
ctccatttgggtatcactcgataatcgttgtggtcaacataccgtatggtctcgg

SEQ ID NO: 3592 - DNA, 55 bp, Artificial Sequence
  Synthetic polynucleotide
gggcacttagcaggtgctgatcgagctccccggtaaactgagtaagccgcgttac

SEQ ID NO: 3593 - DNA, 55 bp, Artificial Sequence
  Synthetic polynucleotide
tagtgtgtcagctgcccagagtataccctgtggaagaggtcaggtggtcgacctt

SEQ ID NO: 3594 - DNA, 55 bp, Artificial Sequence
  Synthetic polynucleotide
cctgtaagcgtcttcgcgaaccacaaaggacggctcctccaaccgcctgtcgaac

SEQ ID NO: 3595 - DNA, 55 bp, Artificial Sequence
  Synthetic polynucleotide
atttgtgcgcactctgccaattcgacggggtggcatgagctatccatggtcatcc

SEQ ID NO: 3596 - DNA, 55 bp, Artificial Sequence
  Synthetic polynucleotide
aatgtcggatcgcccacaggactgtaacgatggccctatcatggctaggacgagt

SEQ ID NO: 3597 - DNA, 55 bp, Artificial Sequence
  Synthetic polynucleotide
cccacactcaaagcgtcgtcagtatacggccggctgcgtgtctagagttattcgc

SEQ ID NO: 3598 - DNA, 55 bp, Artificial Sequence
  Synthetic polynucleotide
gaaaaaatcgcgggtacagacttgatacgccggcgggttctgaattcgagactta

SEQ ID NO: 3599 - DNA, 55 bp, Artificial Sequence
  Synthetic polynucleotide
gccccgccgcactcaccttgagcttgctttcggtcacaggcccgacctcacctgg

SEQ ID NO: 3600 - DNA, 55 bp, Artificial Sequence
  Synthetic polynucleotide
agtgtggaacccaaggcggtaacgtattcctgggggcaaacatgcggccctggcg

SEQ ID NO: 3601 - DNA, 55 bp, Artificial Sequence
  Synthetic polynucleotide
ggccagcagtgcgatccggtagcttaattttggccgcatccggcagctggcgagc

SEQ ID NO: 3602 - DNA, 55 bp, Artificial Sequence
  Synthetic polynucleotide
gccgttggcgtggagccgcttagcattgttcggttgggctagtcgccggccgatg

SEQ ID NO: 3603 - DNA, 55 bp, Artificial Sequence
  Synthetic polynucleotide
ggtgggcgcctggtgccgtttgattgccctagggggtccgccatgcgcttcctta

SEQ ID NO: 3604 - DNA, 55 bp, Artificial Sequence
  Synthetic polynucleotide
accgttctcgtcgcgaccgcgaacaagtctcggatccccccagacaacctctggg

SEQ ID NO: 3605 - DNA, 55 bp, Artificial Sequence
  Synthetic polynucleotide
ggaactagcaagggctctccattccaaaacgggcgtggcgtgatccccgcgtggc

SEQ ID NO: 3606 - DNA, 55 bp, Artificial Sequence
  Synthetic polynucleotide
tctagcccgcgtgacgccgcccagctcgttgggactaacctgccttgagagcggc

SEQ ID NO: 3607 - DNA, 55 bp, Artificial Sequence
  Synthetic polynucleotide
cctccacgagtgaggcccggctgcttacaaggggggttttgaggcgaaggcaaag

SEQ ID NO: 3608 - DNA, 55 bp, Artificial Sequence
  Synthetic polynucleotide
aaacaggtggccccacctaccagccagaaatgggctgacccgcccattggtcccc

SEQ ID NO: 3609 - DNA, 55 bp, Artificial Sequence
  Synthetic polynucleotide
acgatacacgccactgcacgccaaccggagtggctgctggcgtgtctgcggccgg

SEQ ID NO: 3610 - DNA, 55 bp, Artificial Sequence
  Synthetic polynucleotide
ttccctcgcacgtcgaccgtgtgtatgggcgggaagacgtacagggggcggttac

SEQ ID NO: 3611 - DNA, 55 bp, Artificial Sequence
  Synthetic polynucleotide
ccctaccgcggagtggccccttctcaaagatggcgcgcccgtaccaggtctcatt

SEQ ID NO: 3612 - DNA, 55 bp, Artificial Sequence
  Synthetic polynucleotide
gagtcacggaggagcacttcagaaccccgggggggtgccgtaggcctaggcgccg

SEQ ID NO: 3613 - DNA, 55 bp, Artificial Sequence
  Synthetic polynucleotide
atcgcgagctccgagtctctcatgcacagagggttccgtcaacgtcccgtcgccg

SEQ ID NO: 3614 - DNA, 55 bp, Artificial Sequence
  Synthetic polynucleotide
atttagaccgatttaacgggatttatatttcgggatttggtttccacattataaa

SEQ ID NO: 3615 - DNA, 55 bp, Artificial Sequence
  Synthetic polynucleotide
cattattttgtaacaacaggaacaataaaaaggaacacaacatagaactccaaca

SEQ ID NO: 3616 - DNA, 55 bp, Artificial Sequence
  Synthetic polynucleotide
taattactctttaattctatatggtattaatggtataatttatatatcactcgca

SEQ ID NO: 3617 - DNA, 55 bp, Artificial Sequence
  Synthetic polynucleotide
tatttagagtttaaaactgggcagttaaggaggcagttacagtactaaaattaat

SEQ ID NO: 3618 - DNA, 55 bp, Artificial Sequence
  Synthetic polynucleotide
aatttcaagtttaaaacataaaggaaataaaggcgcacgaaagaataaatgcaag

SEQ ID NO: 3619 - DNA, 55 bp, Artificial Sequence
  Synthetic polynucleotide
ttaaaaagagatagtgcatataaaggattaaggattaagatgaagtaaggggtca

SEQ ID NO: 3620 - DNA, 55 bp, Artificial Sequence
  Synthetic polynucleotide
cattgtaaatttaatacgtagtttggtgtatggtatgtaaaatttgtgtgtgttt

SEQ ID NO: 3621 - DNA, 55 bp, Artificial Sequence
  Synthetic polynucleotide
aaatataaaaagtcatctgagaaagggtaaaggatacagtgggtcgaatttatac

SEQ ID NO: 3622 - DNA, 55 bp, Artificial Sequence
  Synthetic polynucleotide
caagtttatgatatatccaggggacgagtaggggatatattttcttgtattataa

SEQ ID NO: 3623 - DNA, 55 bp, Artificial Sequence
  Synthetic polynucleotide
gttaatgatatgtacacagaatcgggggtggggaattattaagaaattcattata

SEQ ID NO: 3624 - DNA, 55 bp, Artificial Sequence
  Synthetic polynucleotide
ttagagaaaacgttgtcaaagaagaatgaatgggtcaagttggataaagatataa

SEQ ID NO: 3625 - DNA, 55 bp, Artificial Sequence
  Synthetic polynucleotide
attattattcgagagtcgtgcattgtgtgtgggtgatatcgtgtaataattttat

SEQ ID NO: 3626 - DNA, 55 bp, Artificial Sequence
  Synthetic polynucleotide
tataaaaagtgaataccagtaaaggacaaagggtaggataaagtgtatacttcaa

SEQ ID NO: 3627 - DNA, 55 bp, Artificial Sequence
  Synthetic polynucleotide
tattatatagctaaagcggataaatgacggcggataagattgatgataattattc

SEQ ID NO: 3628 - DNA, 55 bp, Artificial Sequence
  Synthetic polynucleotide
ataagtgatgtaaaaacattataaacgaacgggcataaaaaaactactacgagcg

SEQ ID NO: 3629 - DNA, 55 bp, Artificial Sequence
  Synthetic polynucleotide
ctaattggaggatgttcaattgggatatttggggggccaaatccttcaaatttac

SEQ ID NO: 3630 - DNA, 55 bp, Artificial Sequence
  Synthetic polynucleotide
tacgtggattaaagttcgttggtcggttcttggtcgtaatgttatgaacaatgtc

SEQ ID NO: 3631 - DNA, 55 bp, Artificial Sequence
  Synthetic polynucleotide
tcctccttgtcatatgcagctggggtatatgggtattaatggtacctatctaaat

SEQ ID NO: 3632 - DNA, 55 bp, Artificial Sequence
  Synthetic polynucleotide
ataatttaattgggttcgtatagtgggtgtggggaaattgctaaccctgtatacc

SEQ ID NO: 3633 - DNA, 55 bp, Artificial Sequence
  Synthetic polynucleotide
tatattagttatccgtcctgttgggatttggggtgggtaagtctagttctaacat

SEQ ID NO: 3634 - DNA, 55 bp, Artificial Sequence
  Synthetic polynucleotide
accactttagtcgtaacgaaggggtatccagggtatatatgaaccggttaaattt

SEQ ID NO: 3635 - DNA, 55 bp, Artificial Sequence
  Synthetic polynucleotide
ctatttctattacattcttggggagagtattggagataaatcaactgggataagt

SEQ ID NO: 3636 - DNA, 55 bp, Artificial Sequence
  Synthetic polynucleotide
ttattaaagttaaattcagagaatgggaatggggctaagtaggaccgcgatgtca

SEQ ID NO: 3637 - DNA, 55 bp, Artificial Sequence
  Synthetic polynucleotide
ttcaatacatcggaatccatatggggccattggggattcaaggtttttgaaagtt

SEQ ID NO: 3638 - DNA, 55 bp, Artificial Sequence
  Synthetic polynucleotide
gttatgtcggataggccttgaaggataggatggaacaagctgtagtgtataaaaa

SEQ ID NO: 3639 - DNA, 55 bp, Artificial Sequence
  Synthetic polynucleotide
gattaataagcacatccgcgatacaagacaaggagagctcaagcaaatatagact

SEQ ID NO: 3640 - DNA, 55 bp, Artificial Sequence
  Synthetic polynucleotide
gtatctttagtagaagccgcaagatggagatggatagatttttggaaaggctatc

SEQ ID NO: 3641 - DNA, 55 bp, Artificial Sequence
  Synthetic polynucleotide
aagcataaagagtttgcgaggtttacagggaggttaagtttttagaaatgcatac

SEQ ID NO: 3642 - DNA, 55 bp, Artificial Sequence
  Synthetic polynucleotide
tcgacattttttaggtcgacggaaacgagacgggaaaatctctaaattcactaca

SEQ ID NO: 3643 - DNA, 55 bp, Artificial Sequence
  Synthetic polynucleotide
aaatgtgaatatcgcgcataataggctggcaggtcgcgcattagaaataaaagat

SEQ ID NO: 3644 - DNA, 55 bp, Artificial Sequence
  Synthetic polynucleotide
tttagtagctgtagggctatgctgggctctggggtcgtaatcaagaatacaaatg

SEQ ID NO: 3645 - DNA, 55 bp, Artificial Sequence
  Synthetic polynucleotide
atactcataccgggatctgggcaaatttctggggaaacgaatttacgctcatgtc

SEQ ID NO: 3646 - DNA, 55 bp, Artificial Sequence
  Synthetic polynucleotide
cggatttactaattctccaatggggctttggggctctgatgcgctatctattcat

SEQ ID NO: 3647 - DNA, 55 bp, Artificial Sequence
  Synthetic polynucleotide
cttacttagctacaatctacgtggggaattgggaacctataaaggggatgtcagt

SEQ ID NO: 3648 - DNA, 55 bp, Artificial Sequence
  Synthetic polynucleotide
aaatgaaacctaaacgctgggggatctatttgggatcctgggtaagtgtgctata

SEQ ID NO: 3649 - DNA, 55 bp, Artificial Sequence
  Synthetic polynucleotide
cataacataagggactcttcttgcttgtcttggggcgaaacttgagcaatcaagt

SEQ ID NO: 3650 - DNA, 55 bp, Artificial Sequence
  Synthetic polynucleotide
tcctatgattcaattactgtggggagcacatgggaggttcaagatattggcgagt

SEQ ID NO: 3651 - DNA, 55 bp, Artificial Sequence
  Synthetic polynucleotide
tagaggctcatggtttccctcgtgggtgggtggcatttaaattaaggttaatagc

SEQ ID NO: 3652 - DNA, 55 bp, Artificial Sequence
  Synthetic polynucleotide
acctaactagcctgaacgggcatattgacggggatatatgctttagcattctgca

SEQ ID NO: 3653 - DNA, 55 bp, Artificial Sequence
  Synthetic polynucleotide
ttggataatgtggcgacgcaacaggtgaacagggagtggctcataatatgatctt

SEQ ID NO: 3654 - DNA, 55 bp, Artificial Sequence
  Synthetic polynucleotide
atatggggcttaggttccctatcgtggtgtgggactctcattcttaattaaagtc

SEQ ID NO: 3655 - DNA, 55 bp, Artificial Sequence
  Synthetic polynucleotide
cacttaacaaaacgggctgagaaagatgaaaggaatagccatgagtgggctagag

SEQ ID NO: 3656 - DNA, 55 bp, Artificial Sequence
  Synthetic polynucleotide
aggcgaataatacggacggctaagaacagacggctaactacgtaaaaaagtctat

SEQ ID NO: 3657 - DNA, 55 bp, Artificial Sequence
  Synthetic polynucleotide
aaatgcacatgacatcctggactggaccactggtaacttggtgactattacagat

SEQ ID NO: 3658 - DNA, 55 bp, Artificial Sequence
  Synthetic polynucleotide
cgttctcggataaacactttagcacggcgggggataacagaagatactagctata

SEQ ID NO: 3659 - DNA, 55 bp, Artificial Sequence
  Synthetic polynucleotide
tcttccctgacggcgacggagggcactcctgggcacaagtgatgaagcggaaaaa

SEQ ID NO: 3660 - DNA, 55 bp, Artificial Sequence
  Synthetic polynucleotide
ggactggtcggtcggtcgggggcataaatggggccgtaatgtcgacgtactctgt

SEQ ID NO: 3661 - DNA, 55 bp, Artificial Sequence
  Synthetic polynucleotide
gatcaattttggaggtcggcgggcctgcctggggtggataagcaaaattactgcg

SEQ ID NO: 3662 - DNA, 55 bp, Artificial Sequence
  Synthetic polynucleotide
aattgaagattggtcccgggtagggcgatttgggctcaacggtgcgcacggaacc

SEQ ID NO: 3663 - DNA, 55 bp, Artificial Sequence
  Synthetic polynucleotide
tctctcgaggtaatctctgccacgggttaccgggtaatcatcctggccccatgtg

SEQ ID NO: 3664 - DNA, 55 bp, Artificial Sequence
  Synthetic polynucleotide
aaggcctggctattaccgagaagggccttcgggcgatacaggggctataccaata

SEQ ID NO: 3665 - DNA, 55 bp, Artificial Sequence
  Synthetic polynucleotide
aggaattatcaatgggcgtcaaccaggctcaggcccgttgccacaggcacgcgta

SEQ ID NO: 3666 - DNA, 55 bp, Artificial Sequence
  Synthetic polynucleotide
tttatgttcgtgctaacgtcccaagctcccaggtacgtccccgagcccgagtggg

SEQ ID NO: 3667 - DNA, 55 bp, Artificial Sequence
  Synthetic polynucleotide
cgttttacagaatcctcttcggggccatgggggtcatggtaaaaagtggtcctct

SEQ ID NO: 3668 - DNA, 55 bp, Artificial Sequence
  Synthetic polynucleotide
tgggcaagggctagcacgtcggcgacagaaaggcgaatacgattacgttaggaat

SEQ ID NO: 3669 - DNA, 55 bp, Artificial Sequence
  Synthetic polynucleotide
cgtttaaatttaaggacaccatgttggagttgggcaagggtctcgcccaggttga

SEQ ID NO: 3670 - DNA, 55 bp, Artificial Sequence
  Synthetic polynucleotide
gcacgcggcgtaaagcctaagatacgcgcgcggccatgtaaccgtaccgctttct

SEQ ID NO: 3671 - DNA, 55 bp, Artificial Sequence
  Synthetic polynucleotide
aatgaagaggactactcaagccatgagagccgggaggatcgataaatggggagta

SEQ ID NO: 3672 - DNA, 55 bp, Artificial Sequence
  Synthetic polynucleotide
cgcggcaactatagacccacattcgcgagcggggcagcaatcgccgatttgattg

SEQ ID NO: 3673 - DNA, 55 bp, Artificial Sequence
  Synthetic polynucleotide
aaacaggacaagtcggcacgaagatcacgaagggggtcggtttcaggaggtcacg

SEQ ID NO: 3674 - DNA, 55 bp, Artificial Sequence
  Synthetic polynucleotide
ccctgcgttctgtcagcccgggtcatttccgggcccttccagcggccaggtgcta

SEQ ID NO: 3675 - DNA, 55 bp, Artificial Sequence
  Synthetic polynucleotide
atgaagggcgggcggccgcgccgagcgcgagggctagatagacgactgtcatggg

SEQ ID NO: 3676 - DNA, 55 bp, Artificial Sequence
  Synthetic polynucleotide
acgcgaccgtgacgggctgccgggcctttggggccgccagagagttgtaacctac

SEQ ID NO: 3677 - DNA, 55 bp, Artificial Sequence
  Synthetic polynucleotide
ctcgagtacagcgtggctaacgcggggtatggggcgaccccgaatgtccggcaac

SEQ ID NO: 3678 - DNA, 55 bp, Artificial Sequence
  Synthetic polynucleotide
gcgcagcagagatcgacctgtctcgggtctcggcggtgtgcctctacaagagggc

SEQ ID NO: 3679 - DNA, 55 bp, Artificial Sequence
  Synthetic polynucleotide
cgtcgcggatacgatccccccacctagtctaggcacctcatcagaccgagctcga

SEQ ID NO: 3680 - DNA, 55 bp, Artificial Sequence
  Synthetic polynucleotide
cccctgacgccagtgtcgttcctccctcccgggacaatctttcagcatagggtcc

SEQ ID NO: 3681 - DNA, 55 bp, Artificial Sequence
  Synthetic polynucleotide
ctttgtcgtgcccaaccagcaccaggggctagggggacgatcgtagcgcgtatga

SEQ ID NO: 3682 - DNA, 55 bp, Artificial Sequence
  Synthetic polynucleotide
actgagtatagggacgcggcacaaacaaacagggtacgccgcgccatggtggcgc

SEQ ID NO: 3683 - DNA, 55 bp, Artificial Sequence
  Synthetic polynucleotide
agcttgcgcgtagaggcgtgcagacgcagacggtcgctgcatatgtgaggccctg

SEQ ID NO: 3684 - DNA, 55 bp, Artificial Sequence
  Synthetic polynucleotide
tccccaggtatgaacgcaacggcgcgaccgcggacattgggcgttttcgaccctt

SEQ ID NO: 3685 - DNA, 55 bp, Artificial Sequence
  Synthetic polynucleotide
ccctcgcacggataggcttgtggcgccgggcggtgcttacgcagccctcataacc

SEQ ID NO: 3686 - DNA, 55 bp, Artificial Sequence
  Synthetic polynucleotide
ccgacgcgtgcgttgactatggtacgccgccggcccggccgctcgagagcgctag

SEQ ID NO: 3687 - DNA, 55 bp, Artificial Sequence
  Synthetic polynucleotide
ccactaactaagctcccggacacggtgaggtgggccccaagcgacggcctctcgg

SEQ ID NO: 3688 - DNA, 55 bp, Artificial Sequence
  Synthetic polynucleotide
cgggtggaaacagaggcttcggttgccagccggcggaggaggccacatacgtcac

SEQ ID NO: 3689 - DNA, 55 bp, Artificial Sequence
  Synthetic polynucleotide
taataggatggttgggctggtaattaaaaatgggtaattgtttatgcagttttga

SEQ ID NO: 3690 - DNA, 55 bp, Artificial Sequence
  Synthetic polynucleotide
aataccggtgatttgactgggtaaattattgggttttaatggctgtttaataaag

SEQ ID NO: 3691 - DNA, 55 bp, Artificial Sequence
  Synthetic polynucleotide
tagcagatatttataacaatataataaataaggattatttaaagtatattatttt

SEQ ID NO: 3692 - DNA, 55 bp, Artificial Sequence
  Synthetic polynucleotide
tattatagagctaactctttgctggttctttggcttatagggttatttgatattt

SEQ ID NO: 3693 - DNA, 55 bp, Artificial Sequence
  Synthetic polynucleotide
atttcatagtataaaacgggaggaaaaaaaaggaatcaaagacagctaggtttaa

SEQ ID NO: 3694 - DNA, 55 bp, Artificial Sequence
  Synthetic polynucleotide
ttcatctttttattacctagttggatgtttgggttggttttatgaaggattaaat

SEQ ID NO: 3695 - DNA, 55 bp, Artificial Sequence
  Synthetic polynucleotide
gaattcagagtttgatctataagaaataagaggagctaatctgtataaaagaagc

SEQ ID NO: 3696 - DNA, 55 bp, Artificial Sequence
  Synthetic polynucleotide
aaatcaaaattttaaactagtgcagggacggggtttttttagacccattttaaat

SEQ ID NO: 3697 - DNA, 55 bp, Artificial Sequence
  Synthetic polynucleotide
ctaatgaagttaaattcagtgaaggtaagtaggtcatattgtaagtgtattaaac

SEQ ID NO: 3698 - DNA, 55 bp, Artificial Sequence
  Synthetic polynucleotide
aattaactgatattaactaaaagagtgaagcggtgagttaagattggagttggta

SEQ ID NO: 3699 - DNA, 55 bp, Artificial Sequence
  Synthetic polynucleotide
cctttgaagtaaaagactaaaaggttaggaaggaaaaataacatatgttcaagaa

SEQ ID NO: 3700 - DNA, 55 bp, Artificial Sequence
  Synthetic polynucleotide
atttcaggattcgtatctaaagaaaagaagcggtactaaaagacttaagatctaa

SEQ ID NO: 3701 - DNA, 55 bp, Artificial Sequence
  Synthetic polynucleotide
ctctgtgatcaagttacaaaaggggattgctgggaaaaaaagaattttaacataa

SEQ ID NO: 3702 - DNA, 55 bp, Artificial Sequence
  Synthetic polynucleotide
aaatggtatatatgatcaatagaaaggagagggtttaaaaaaaagagtattcata

SEQ ID NO: 3703 - DNA, 55 bp, Artificial Sequence
  Synthetic polynucleotide
agagattcttttatatcttatagaaaacgaaggaaaaaaaagctcaatagaaaac

SEQ ID NO: 3704 - DNA, 55 bp, Artificial Sequence
  Synthetic polynucleotide
tcctatttctctgcttcagactcttattcttggactcatgtattctttttagcag

SEQ ID NO: 3705 - DNA, 55 bp, Artificial Sequence
  Synthetic polynucleotide
cgaaggtatattgaatcggggagtaattagggggttctactattattagcactag

SEQ ID NO: 3706 - DNA, 55 bp, Artificial Sequence
  Synthetic polynucleotide
cattcgggaattcaatccgggcatttattatggggcacattattatactttctct

SEQ ID NO: 3707 - DNA, 55 bp, Artificial Sequence
  Synthetic polynucleotide
attgagaacgccaactcggtttccacatcacggtcgaccattatacttaattata

SEQ ID NO: 3708 - DNA, 55 bp, Artificial Sequence
  Synthetic polynucleotide
gtatgagagtcgacttcggggggagagttttgggatggaagttaaaatttattaa

SEQ ID NO: 3709 - DNA, 55 bp, Artificial Sequence
  Synthetic polynucleotide
gtttacagatgtttatctggaagtaagttaagggtttgtgagtaaaagaggtggc

SEQ ID NO: 3710 - DNA, 55 bp, Artificial Sequence
  Synthetic polynucleotide
atccatagtatgcagacatataaggggattgggtagaaccttaaagggtacttgt

SEQ ID NO: 3711 - DNA, 55 bp, Artificial Sequence
  Synthetic polynucleotide
ttactatgtctatcatcctaatggccctcccggccatacaattaatctttattga

SEQ ID NO: 3712 - DNA, 55 bp, Artificial Sequence
  Synthetic polynucleotide
aaattattccgtcatacaggacgtggttgggggccaatgtacatgtattatcaat

SEQ ID NO: 3713 - DNA, 55 bp, Artificial Sequence
  Synthetic polynucleotide
tttataagtattattgcctggtgtgtggtgaggcggtgagtctataacataacta

SEQ ID NO: 3714 - DNA, 55 bp, Artificial Sequence
  Synthetic polynucleotide
gatattttgtgggatccggaagtcaaggaagggggttttttaacaacaactgata

SEQ ID NO: 3715 - DNA, 55 bp, Artificial Sequence
  Synthetic polynucleotide
attacagttatcttgacaggggtactgcaagggtcaggttataaactgtaaacga

SEQ ID NO: 3716 - DNA, 55 bp, Artificial Sequence
  Synthetic polynucleotide
acgttttaccatggaacaccacacaaccactggctttctttgattcacacattta

SEQ ID NO: 3717 - DNA, 55 bp, Artificial Sequence
  Synthetic polynucleotide
tgatgactgtgattcgcaagggtattagggaggtagccattatattgtttatgtt

SEQ ID NO: 3718 - DNA, 55 bp, Artificial Sequence
  Synthetic polynucleotide
atcgtctagggttatgcaaggcattggaggtggttaatatctcggaaacattaat

SEQ ID NO: 3719 - DNA, 55 bp, Artificial Sequence
  Synthetic polynucleotide
aggaatcataatcctgctgacagctcttctaggcctaatcttcattaggctcacg

SEQ ID NO: 3720 - DNA, 55 bp, Artificial Sequence
  Synthetic polynucleotide
atatttatgaattggtcgtgggccagttctgggggcatattttccgtgacaaaca

SEQ ID NO: 3721 - DNA, 55 bp, Artificial Sequence
  Synthetic polynucleotide
tctatcaattacgggccgctggtttagtctgggttcgagaatgtttgaaaaaatg

SEQ ID NO: 3722 - DNA, 55 bp, Artificial Sequence
  Synthetic polynucleotide
gaccaaaacggtatcacggtatcgtatttgggggacgtatactcactatagcaga

SEQ ID NO: 3723 - DNA, 55 bp, Artificial Sequence
  Synthetic polynucleotide
aataaacgtgttggttccgcaagagggtctgggcgtataaggagtcaaacattag

SEQ ID NO: 3724 - DNA, 55 bp, Artificial Sequence
  Synthetic polynucleotide
gttcgttctggttaacccagatcttgggctgggtgggggtatatttataagtgaa

SEQ ID NO: 3725 - DNA, 55 bp, Artificial Sequence
  Synthetic polynucleotide
aagattcttgatagaccggcgctaggtacacggcataagacgcgctaaaaataag

SEQ ID NO: 3726 - DNA, 55 bp, Artificial Sequence
  Synthetic polynucleotide
tatcgagcatgaattccacgtggttggttgtgggatgaatgaccaaggcttagtt

SEQ ID NO: 3727 - DNA, 55 bp, Artificial Sequence
  Synthetic polynucleotide
aacagaattttgacagcatgggaagagatgggggatcggatcaagaattcccgaa

SEQ ID NO: 3728 - DNA, 55 bp, Artificial Sequence
  Synthetic polynucleotide
ggtttgggattgtccgcgtggaaaagtgagtgggatcatgtacgtttttaatctc

SEQ ID NO: 3729 - DNA, 55 bp, Artificial Sequence
  Synthetic polynucleotide
attataaagcgttacaccctcaaggtgagcgggtgtttggtctgcttattcatga

SEQ ID NO: 3730 - DNA, 55 bp, Artificial Sequence
  Synthetic polynucleotide
tgaatttagtttgcgcctttggaggagtgaaggtaagcgcttttgaacaaagtgt

SEQ ID NO: 3731 - DNA, 55 bp, Artificial Sequence
  Synthetic polynucleotide
gtataacgagtttgttcaggagaagatggatggcacaggttaagtgagattgcgt

SEQ ID NO: 3732 - DNA, 55 bp, Artificial Sequence
  Synthetic polynucleotide
ctatagatacataggtcataagacccgcaccggaatttacccctcagcctgaaaa

SEQ ID NO: 3733 - DNA, 55 bp, Artificial Sequence
  Synthetic polynucleotide
atctaagatatttgatctgagtgtcagagatggagtcaggaaagtcaatccgcga

SEQ ID NO: 3734 - DNA, 55 bp, Artificial Sequence
  Synthetic polynucleotide
gagaagtgcggctcggctggtctgctgtctgggctgcatgttaattgtgaagagc

SEQ ID NO: 3735 - DNA, 55 bp, Artificial Sequence
  Synthetic polynucleotide
cacgtgggggtttcgtcgtgggggtattcacgggtgttccgactgaaaccagagc

SEQ ID NO: 3736 - DNA, 55 bp, Artificial Sequence
  Synthetic polynucleotide
gttaatcttcgctgggcgattacggcaacgcggtatcgtaccacgcagcaaatat

SEQ ID NO: 3737 - DNA, 55 bp, Artificial Sequence
  Synthetic polynucleotide
ctgacgtggagcgcgcccaacagggctgctaggactccacaagttgtggattacg

SEQ ID NO: 3738 - DNA, 55 bp, Artificial Sequence
  Synthetic polynucleotide
actgaatagggctggcccgaccgtagggctaggagcacacgttgagtttactgag

SEQ ID NO: 3739 - DNA, 55 bp, Artificial Sequence
  Synthetic polynucleotide
ttaaggcaatagacaccccacaggggggccgggtttctggtcttgcggcaatcgc

SEQ ID NO: 3740 - DNA, 55 bp, Artificial Sequence
  Synthetic polynucleotide
aaccatgcaccttcgcccaccctttccgcctgggcattgtagatcctaatgtccc

SEQ ID NO: 3741 - DNA, 55 bp, Artificial Sequence
  Synthetic polynucleotide
ggcttatctccagcgaccttccctatcccctggaagcctgatacacggttgaaaa

SEQ ID NO: 3742 - DNA, 55 bp, Artificial Sequence
  Synthetic polynucleotide
attacgatatgagaaacagggggtatggaaggggaacttacccaaatacaggggg

SEQ ID NO: 3743 - DNA, 55 bp, Artificial Sequence
  Synthetic polynucleotide
agtgaatacctatccccagcggtgtgtcggcggaatggggtcgttatgacgagaa

SEQ ID NO: 3744 - DNA, 55 bp, Artificial Sequence
  Synthetic polynucleotide
gaacacgtcacatacccccggagatcgaaccggcccttcgctttaatagaacggt

SEQ ID NO: 3745 - DNA, 55 bp, Artificial Sequence
  Synthetic polynucleotide
gcgggatccgtctctgctgggacgcccggatggtaccagaaggcgtgattaacta

SEQ ID NO: 3746 - DNA, 55 bp, Artificial Sequence
  Synthetic polynucleotide
ccttctttcaagagggcgctatagcaggggcggcgagatagctcacctggttggt

SEQ ID NO: 3747 - DNA, 55 bp, Artificial Sequence
  Synthetic polynucleotide
tgctgagacataccgactgtcctgcaccaccggattacctttcccgaggacgagt

SEQ ID NO: 3748 - DNA, 55 bp, Artificial Sequence
  Synthetic polynucleotide
tagtccacactggacacaagtatgcgggggaggcgttgacctgttctcgtcgatc

SEQ ID NO: 3749 - DNA, 55 bp, Artificial Sequence
  Synthetic polynucleotide
atttaggagggcccgtcgggtgcgctcgctgggtggtgcggggcagtaccaagga

SEQ ID NO: 3750 - DNA, 55 bp, Artificial Sequence
  Synthetic polynucleotide
cgggtgctagtggcttccggcggctggtttgggcaggtaacagaaggagggtccc

SEQ ID NO: 3751 - DNA, 55 bp, Artificial Sequence
  Synthetic polynucleotide
aagcggggtcgctgccccggttggcttccatggtggcccggcgacccacggttta

SEQ ID NO: 3752 - DNA, 55 bp, Artificial Sequence
  Synthetic polynucleotide
cggccggagttcgtgacggctggtgggtgcgggcgatcagtcgtaatcgacggcc

SEQ ID NO: 3753 - DNA, 55 bp, Artificial Sequence
  Synthetic polynucleotide
caggtgctccaggggccctggccctgcctagggccgatgcagaacatccgaaatc

SEQ ID NO: 3754 - DNA, 55 bp, Artificial Sequence
  Synthetic polynucleotide
ttaagtcggctttaggcgggggtggtctccggggatcgcggaggtatgcaaaggg

SEQ ID NO: 3755 - DNA, 55 bp, Artificial Sequence
  Synthetic polynucleotide
gactcaaccctggctcccacgccatggccgtggtggttaaacgttcgagaccctc

SEQ ID NO: 3756 - DNA, 55 bp, Artificial Sequence
  Synthetic polynucleotide
tgcagggtgcaccatgcggaacctcaggcggggcgtcacgcatacgttgggctcg

SEQ ID NO: 3757 - DNA, 55 bp, Artificial Sequence
  Synthetic polynucleotide
caaacagtgaattgaaccgtgtgagggcccgggctccccagtggttctgggcgct

SEQ ID NO: 3758 - DNA, 55 bp, Artificial Sequence
  Synthetic polynucleotide
agcaatcgaacgttagcgcgaccgtggaaccggcccagtcctttcgcccgtctct

SEQ ID NO: 3759 - DNA, 55 bp, Artificial Sequence
  Synthetic polynucleotide
ttcgggggttcattcccgcggaaggcacgcaggcgggtcagatgcgggcgacact

SEQ ID NO: 3760 - DNA, 55 bp, Artificial Sequence
  Synthetic polynucleotide
gcgtgggtagtaaaagccccccggctccgggggagagcccactcacgcgaacggg

SEQ ID NO: 3761 - DNA, 55 bp, Artificial Sequence
  Synthetic polynucleotide
gtcttgggtagaggtccgagacgtctccgtagggtcctgactcgctcgaacggtc

SEQ ID NO: 3762 - DNA, 55 bp, Artificial Sequence
  Synthetic polynucleotide
acgacaccagtcgatccgaggtatcccgggaggagcaccgatcacaggcccagga

SEQ ID NO: 3763 - DNA, 55 bp, Artificial Sequence
  Synthetic polynucleotide
cgccagattggtcggccaggtggtaacaggaggtagatgaccgtgggtcgaggcc

SEQ ID NO: 3764 - DNA, 55 bp, Artificial Sequence
  Synthetic polynucleotide
catgggaggttatttaccaatgtattatttaggtatttacctatattattctttt

SEQ ID NO: 3765 - DNA, 55 bp, Artificial Sequence
  Synthetic polynucleotide
ctaggggaaccattaactattaaataaattaggaaaaaaaacgtaatttactgca

SEQ ID NO: 3766 - DNA, 55 bp, Artificial Sequence
  Synthetic polynucleotide
agacacacggtttgtgctttattcttatttaggtgttatttcttaactacatatc

SEQ ID NO: 3767 - DNA, 55 bp, Artificial Sequence
  Synthetic polynucleotide
actttacacaaaaaaactgaaaacaattatgggaaaaacaaactggacgtatgga

SEQ ID NO: 3768 - DNA, 55 bp, Artificial Sequence
  Synthetic polynucleotide
catatttatatcttatctcttctgagatcttggtatctttaagaggttgaagtaa

SEQ ID NO: 3769 - DNA, 55 bp, Artificial Sequence
  Synthetic polynucleotide
tgatttaggccaaggacaattaaaaaataaaggatcttttaaaaaaataccttaa

SEQ ID NO: 3770 - DNA, 55 bp, Artificial Sequence
  Synthetic polynucleotide
caatcgagaacaaagacatgatatataacttggacatgattataatatataatga

SEQ ID NO: 3771 - DNA, 55 bp, Artificial Sequence
  Synthetic polynucleotide
acttttgtttggaggtcagggaagtttcattgggaatagtaatttaattagagaa

SEQ ID NO: 3772 - DNA, 55 bp, Artificial Sequence
  Synthetic polynucleotide
cgttattagctgaatacttgttgttatgtttggactgaattgatttaaatggaaa

SEQ ID NO: 3773 - DNA, 55 bp, Artificial Sequence
  Synthetic polynucleotide
atattaaattggttagcgaaatgaatgaattggtgtgaagtatgatagacacgca

SEQ ID NO: 3774 - DNA, 55 bp, Artificial Sequence
  Synthetic polynucleotide
gataacatcaatcgaacgaaaaactaactacggaaacactgaaaaataggataag

SEQ ID NO: 3775 - DNA, 55 bp, Artificial Sequence
  Synthetic polynucleotide
caaagatagatagaaacaaaaactacgcaaaggcttacaacaatcatatactatg

SEQ ID NO: 3776 - DNA, 55 bp, Artificial Sequence
  Synthetic polynucleotide
ttactagtcgtgtgtgctatggttaagggaaggtggtatataagttatttaaaat

SEQ ID NO: 3777 - DNA, 55 bp, Artificial Sequence
  Synthetic polynucleotide
tagttttttcccctgtctaaggttaacagtaggtcctaaatttctaagctttaaa

SEQ ID NO: 3778 - DNA, 55 bp, Artificial Sequence
  Synthetic polynucleotide
aaatgataatctaacacgaaaaaaaccaacaggaaaattaagataacattacaag

SEQ ID NO: 3779 - DNA, 55 bp, Artificial Sequence
  Synthetic polynucleotide
taagtgtttttagcaaccgaggggttatttgggaagtaactttaggctccaatag

SEQ ID NO: 3780 - DNA, 55 bp, Artificial Sequence
  Synthetic polynucleotide
ccgccaatttatgaatcggtttgtttattttggtattttctcaggcaaatgcaac

SEQ ID NO: 3781 - DNA, 55 bp, Artificial Sequence
  Synthetic polynucleotide
ttgttataataacgcactggctgcctttaaaggctcactgctctataacacctta

SEQ ID NO: 3782 - DNA, 55 bp, Artificial Sequence
  Synthetic polynucleotide
atctatctatgtatgcctgtatgaggcttgtggtgtgagctcgaaaagataatgt

SEQ ID NO: 3783 - DNA, 55 bp, Artificial Sequence
  Synthetic polynucleotide
gcttggttattggccgcaaaaacgtattattggaataaacgtaaacgatgactta

SEQ ID NO: 3784 - DNA, 55 bp, Artificial Sequence
  Synthetic polynucleotide
tataggcagctttgtgcatgattctgtctttggtgtttctgttatgtagggattg

SEQ ID NO: 3785 - DNA, 55 bp, Artificial Sequence
  Synthetic polynucleotide
aacaattgaatgcactcctagaagagaaattgggaagaagacgatataggaaccc

SEQ ID NO: 3786 - DNA, 55 bp, Artificial Sequence
  Synthetic polynucleotide
gacataaccctaatagccgatacgaaaacccggaatagtgaaatatgtgattttg

SEQ ID NO: 3787 - DNA, 55 bp, Artificial Sequence
  Synthetic polynucleotide
cttacagtagtctacactaaaacaaggacgcggaacgaatacacaaaaactacaa

SEQ ID NO: 3788 - DNA, 55 bp, Artificial Sequence
  Synthetic polynucleotide
taaccgcgtcataaaactcctatcctcacccggtatcattattctgtacgattat

SEQ ID NO: 3789 - DNA, 55 bp, Artificial Sequence
  Synthetic polynucleotide
ttaaaggtatttcgcgcaactggatagcaaaggatgcgctgaacacttaatatga

SEQ ID NO: 3790 - DNA, 55 bp, Artificial Sequence
  Synthetic polynucleotide
atgcactgagcaatttcaagatttgggtgatggctagtgggtgttcaaatttttt

SEQ ID NO: 3791 - DNA, 55 bp, Artificial Sequence
  Synthetic polynucleotide
ttaaggtatgctgggtcagacaggcaaaggtggaacagaacaattatttttgcaa

SEQ ID NO: 3792 - DNA, 55 bp, Artificial Sequence
  Synthetic polynucleotide
agagtggcatgatttgcagaccgacaacagtggataagactagaaagttaacatt

SEQ ID NO: 3793 - DNA, 55 bp, Artificial Sequence
  Synthetic polynucleotide
tttagaaaaaattgtacagggtcagacgagaggggggattttttatagcaaatat

SEQ ID NO: 3794 - DNA, 55 bp, Artificial Sequence
  Synthetic polynucleotide
tgataaacgggctgttcgctgaaggggctttggttggttcgttagtactttttaa

SEQ ID NO: 3795 - DNA, 55 bp, Artificial Sequence
  Synthetic polynucleotide
ttttgggtggggccatcatgaggatatttaaggggaacatggatactgaagatga

SEQ ID NO: 3796 - DNA, 55 bp, Artificial Sequence
  Synthetic polynucleotide
taccaattaggcggttctgcctcgtcatttcggttagctgtcagtttgaagtaat

SEQ ID NO: 3797 - DNA, 55 bp, Artificial Sequence
  Synthetic polynucleotide
atttctgggaaagagtctagcggcaaatagagggaaaatgggtcatttagcctga

SEQ ID NO: 3798 - DNA, 55 bp, Artificial Sequence
  Synthetic polynucleotide
ccatataattggctaacaggtaggggtgcttggttaccgttaggacatttcgatc

SEQ ID NO: 3799 - DNA, 55 bp, Artificial Sequence
  Synthetic polynucleotide
tacccctttcacctttcgtggtctaatcctgggttctgacttctaagacgtaaaa

SEQ ID NO: 3800 - DNA, 55 bp, Artificial Sequence
  Synthetic polynucleotide
ttatcatccatcggtgcggtaatcaggttccgggttgaaaagggatagtaatgtg

SEQ ID NO: 3801 - DNA, 55 bp, Artificial Sequence
  Synthetic polynucleotide
aatcactagccatgcgccattcgaggtgcccggagtcacatagtgatttattaaa

SEQ ID NO: 3802 - DNA, 55 bp, Artificial Sequence
  Synthetic polynucleotide
ctgctaaatatctagtcagttgggcatgtatggtgatctaggtcatagcagcctg

SEQ ID NO: 3803 - DNA, 55 bp, Artificial Sequence
  Synthetic polynucleotide
tataccgataggacctcagccctacagacaaggaaccttatcaggctgtacaaat

SEQ ID NO: 3804 - DNA, 55 bp, Artificial Sequence
  Synthetic polynucleotide
acactcttgaacgggacagcaggatcaagagggacagtcttaagtatgtgtgatt

SEQ ID NO: 3805 - DNA, 55 bp, Artificial Sequence
  Synthetic polynucleotide
gcgggttaggttggtgctaatacgcttcggtgggtaatataaatccgctaatttt

SEQ ID NO: 3806 - DNA, 55 bp, Artificial Sequence
  Synthetic polynucleotide
tttgttatattaaacgcaagggttcccggccggcattcaagtttgtggttatacg

SEQ ID NO: 3807 - DNA, 55 bp, Artificial Sequence
  Synthetic polynucleotide
ccagatggttaacaaacacaactacacaagtggtacaacctggcacgtaatagca

SEQ ID NO: 3808 - DNA, 55 bp, Artificial Sequence
  Synthetic polynucleotide
gtaagtaatggggatccaggtagtcaaaggcggagagataccctagtatactatt

SEQ ID NO: 3809 - DNA, 55 bp, Artificial Sequence
  Synthetic polynucleotide
gatcctggccaaacttcaggccgctcttcctgggctatattaggggtctgggtta

SEQ ID NO: 3810 - DNA, 55 bp, Artificial Sequence
  Synthetic polynucleotide
tttcaccgccctggcgcggaatcgccttctcggactagcggggccagaaagaatt

SEQ ID NO: 3811 - DNA, 55 bp, Artificial Sequence
  Synthetic polynucleotide
tattattctcatggagcgccttgcgctttacggtcatgctcgggtatgctcgctt

SEQ ID NO: 3812 - DNA, 55 bp, Artificial Sequence
  Synthetic polynucleotide
tcttagctctctggaacctgtcgactgccttggacgcgtcccggggtatgtccta

SEQ ID NO: 3813 - DNA, 55 bp, Artificial Sequence
  Synthetic polynucleotide
ggcccgggctcggctgctcggaactgtgctaggcttgactccgtaagtttattca

SEQ ID NO: 3814 - DNA, 55 bp, Artificial Sequence
  Synthetic polynucleotide
tagcggcatacttcgtctttgaggcttacgcgggagcctctacctgccatgattt

SEQ ID NO: 3815 - DNA, 55 bp, Artificial Sequence
  Synthetic polynucleotide
cgtcccggtagcgaaacgcatcacaccgcctggacgacgagatgttgcgagatca

SEQ ID NO: 3816 - DNA, 55 bp, Artificial Sequence
  Synthetic polynucleotide
ttggagcgggtaggtactacagcgcgtactgggccgaactagacccagccaaggt

SEQ ID NO: 3817 - DNA, 55 bp, Artificial Sequence
  Synthetic polynucleotide
tcgctgacaccctagtcccaaactggcgcacgggagctcccctatgaattacgcc

SEQ ID NO: 3818 - DNA, 55 bp, Artificial Sequence
  Synthetic polynucleotide
caagatggtccgttgtcgagactgatcgcgaggtgtccaacgcatgcggaacacg

SEQ ID NO: 3819 - DNA, 55 bp, Artificial Sequence
  Synthetic polynucleotide
gtttaaaggcacgacacctagtggcaagtttggacacggcggctcgaaatatcac

SEQ ID NO: 3820 - DNA, 55 bp, Artificial Sequence
  Synthetic polynucleotide
acagcgataatgagcgctcccgacccggagcggggaagatagaaacctatagtat

SEQ ID NO: 3821 - DNA, 55 bp, Artificial Sequence
  Synthetic polynucleotide
agccaggttttagagacattccagtgcagccggagggactgtaccatgtcacgga

SEQ ID NO: 3822 - DNA, 55 bp, Artificial Sequence
  Synthetic polynucleotide
actgtgctagtatagccgatataccgctgagggcccggcaagactcgcagcaccc

SEQ ID NO: 3823 - DNA, 55 bp, Artificial Sequence
  Synthetic polynucleotide
agtcaccgcggaccctcggatacggacaggtggcccccatgtagaattataactg

SEQ ID NO: 3824 - DNA, 55 bp, Artificial Sequence
  Synthetic polynucleotide
ttcgcttggtggcagccccgcggcgccgctggggtagattagaggcgcctcaaga

SEQ ID NO: 3825 - DNA, 55 bp, Artificial Sequence
  Synthetic polynucleotide
aagcatagtccacctgcgcgttgagtttcgtggcggtcctgacagccagggtgcc

SEQ ID NO: 3826 - DNA, 55 bp, Artificial Sequence
  Synthetic polynucleotide
catgtaggccatccgtctggcctgccttctcgggccgtcggaaagacaacccctg

SEQ ID NO: 3827 - DNA, 55 bp, Artificial Sequence
  Synthetic polynucleotide
ttgctgcatcgccgcgcgcgactggagtctcgggaaccccgatgcaatcacgact

SEQ ID NO: 3828 - DNA, 55 bp, Artificial Sequence
  Synthetic polynucleotide
tacaactacgtccgtccacctacgctgcttggggaacgcacgccgcgcgggtatt

SEQ ID NO: 3829 - DNA, 55 bp, Artificial Sequence
  Synthetic polynucleotide
aggaccaagccagcgtcgcggccgctattctggcaagcgggagtacgcggcgcgc

SEQ ID NO: 3830 - DNA, 55 bp, Artificial Sequence
  Synthetic polynucleotide
acagcgctgcttggagcgtctacctggcagtggcgtcagttgcctgggtgcccat

SEQ ID NO: 3831 - DNA, 55 bp, Artificial Sequence
  Synthetic polynucleotide
ctctgttcacacccaacccgcggtggcacacgggagtcgctgcgtttctctccga

SEQ ID NO: 3832 - DNA, 55 bp, Artificial Sequence
  Synthetic polynucleotide
gtgtcgcacgcatacgctgttgcttcgccgtggagggctattgtgcagcccgggc

SEQ ID NO: 3833 - DNA, 55 bp, Artificial Sequence
  Synthetic polynucleotide
cgaattgtggccccagcgaatgcgctgggcagggtccggggggtgcaaaaacctt

SEQ ID NO: 3834 - DNA, 55 bp, Artificial Sequence
  Synthetic polynucleotide
tcgacggcctgggttgcgatggcgagcagagggaacaagctaagctggttccacg

SEQ ID NO: 3835 - DNA, 55 bp, Artificial Sequence
  Synthetic polynucleotide
catctttcccgcgggtcctgacatccagtctggtcggccactccacgactttggc

SEQ ID NO: 3836 - DNA, 55 bp, Artificial Sequence
  Synthetic polynucleotide
tggagttgacgtagtgcggaggcacagagccggctcggaatgccggctgtgatag

SEQ ID NO: 3837 - DNA, 55 bp, Artificial Sequence
  Synthetic polynucleotide
cggttgccggtttaggccgaaacctgccaacggctcaccgaagatcgtgggcagt

SEQ ID NO: 3838 - DNA, 55 bp, Artificial Sequence
  Synthetic polynucleotide
tgggcgacacgtcgcgcctttaggccccgcgggcgtttgtaagcgtcagagtttg

SEQ ID NO: 3839 - DNA, 55 bp, Artificial Sequence
  Synthetic polynucleotide
acctatcttatggctactctttaaatttattgggttacctcttttaattaatttt

SEQ ID NO: 3840 - DNA, 55 bp, Artificial Sequence
  Synthetic polynucleotide
tacttttatttgtaagcaaataattaaaaatggcataatagtaatataaaaatga

SEQ ID NO: 3841 - DNA, 55 bp, Artificial Sequence
  Synthetic polynucleotide
taacatatattcataacatattatttattttggtcgtatattattatttcctgaa

SEQ ID NO: 3842 - DNA, 55 bp, Artificial Sequence
  Synthetic polynucleotide
attttttaacaagggacggatttagaattaaggtgggtgaaaatagaaattggct

SEQ ID NO: 3843 - DNA, 55 bp, Artificial Sequence
  Synthetic polynucleotide
gtaaggattaaagtcgcgttgaaataaaaaaggtgaacattgtaaattaatttac

SEQ ID NO: 3844 - DNA, 55 bp, Artificial Sequence
  Synthetic polynucleotide
tgcgaggggaaaaaaacagcttattatctttggaaatttatatagcttgacaatt

SEQ ID NO: 3845 - DNA, 55 bp, Artificial Sequence
  Synthetic polynucleotide
gtaattttgcttataacaaaacgaaagtaatggtaaaaacggtatacacgaaacg

SEQ ID NO: 3846 - DNA, 55 bp, Artificial Sequence
  Synthetic polynucleotide
tcatgatgcagctatactaaaaaaggtatatggcgtaaaaaatagggagatttat

SEQ ID NO: 3847 - DNA, 55 bp, Artificial Sequence
  Synthetic polynucleotide
attcaattgtgtggttctgaaaaacaaaactggattaaaaaaaaactctcactgc

SEQ ID NO: 3848 - DNA, 55 bp, Artificial Sequence
  Synthetic polynucleotide
aacttagataatttggcgttgaagagtgtaaggaatggttgaaaaaaagtaagaa

SEQ ID NO: 3849 - DNA, 55 bp, Artificial Sequence
  Synthetic polynucleotide
gaaaaaaggaacaaaactaatgtagtcaaaaggctattcaaacctctcactacat

SEQ ID NO: 3850 - DNA, 55 bp, Artificial Sequence
  Synthetic polynucleotide
tatgagtattagtagtcgaaagatataagtaggaattatagaacactggatgctt

SEQ ID NO: 3851 - DNA, 55 bp, Artificial Sequence
  Synthetic polynucleotide
attctttggtgtttcccaagaaaccaacacaggaaaagaacaaaaaataatatac

SEQ ID NO: 3852 - DNA, 55 bp, Artificial Sequence
  Synthetic polynucleotide
tccaacatttcaagaacgagataaagcaaacggatagtataacaagaaaagctat

SEQ ID NO: 3853 - DNA, 55 bp, Artificial Sequence
  Synthetic polynucleotide
tacctaataataagagctagtaaaaaccaaagggctaaagagtttaaaatcgtgt

SEQ ID NO: 3854 - DNA, 55 bp, Artificial Sequence
  Synthetic polynucleotide
gttgtaaagaatgttacggccggtttaatgggggaatcgggttcaaataattcaa

SEQ ID NO: 3855 - DNA, 55 bp, Artificial Sequence
  Synthetic polynucleotide
atacggaaactggggtctattgtttcgtctgggggaatactctttgctttatttt

SEQ ID NO: 3856 - DNA, 55 bp, Artificial Sequence
  Synthetic polynucleotide
atgggggttcttaactcatgtgtctatttggggcgctatatatagtgtgtacaat

SEQ ID NO: 3857 - DNA, 55 bp, Artificial Sequence
  Synthetic polynucleotide
taataggctttcgctgctttgtatttgttctggtgatgctttaggggaagattta

SEQ ID NO: 3858 - DNA, 55 bp, Artificial Sequence
  Synthetic polynucleotide
aattatctcggtgatgcgtgctgaataatgtgggcataactgttgtgtgaatcaa

SEQ ID NO: 3859 - DNA, 55 bp, Artificial Sequence
  Synthetic polynucleotide
aataggcctacatggcctggaagatattaggggcagttagaattaagttatcata

SEQ ID NO: 3860 - DNA, 55 bp, Artificial Sequence
  Synthetic polynucleotide
gatctagagtttcgaccttaccgcaatgatcggaccacgtatacatgtataatat

SEQ ID NO: 3861 - DNA, 55 bp, Artificial Sequence
  Synthetic polynucleotide
caaaaagttaacatagcgcaagttagtaaaaggttcaagccaattccatcgaacg

SEQ ID NO: 3862 - DNA, 55 bp, Artificial Sequence
  Synthetic polynucleotide
aaattattaatctactctgtcctgttcaaacgggtctctgtcgatgtccttctga

SEQ ID NO: 3863 - DNA, 55 bp, Artificial Sequence
  Synthetic polynucleotide
tttaagtggtaaagatccaagcataagacgcggcagaccagcaagaaataagatt

SEQ ID NO: 3864 - DNA, 55 bp, Artificial Sequence
  Synthetic polynucleotide
gttcaagaaggtgccacaaaaggaagttgatggggtcaagtgttagaataagtaa

SEQ ID NO: 3865 - DNA, 55 bp, Artificial Sequence
  Synthetic polynucleotide
tatatatgacttagctccaacccttcgatcaggcccaatactctttcctagtata

SEQ ID NO: 3866 - DNA, 55 bp, Artificial Sequence
  Synthetic polynucleotide
cttgaggtataagttcctaagtcaaacagaagggtccacaaagagagtatcagaa

SEQ ID NO: 3867 - DNA, 55 bp, Artificial Sequence
  Synthetic polynucleotide
ccggttcgatgttgtacgtgacataaaggttggtaacgtgtaagatataatgctt

SEQ ID NO: 3868 - DNA, 55 bp, Artificial Sequence
  Synthetic polynucleotide
tacggtattaatagggcaattgaattgaggcgggagccaataaaagatgttaaaa

SEQ ID NO: 3869 - DNA, 55 bp, Artificial Sequence
  Synthetic polynucleotide
tagaattatgtctagtccccacacctttctagggtctagtccccttagtgcaaga

SEQ ID NO: 3870 - DNA, 55 bp, Artificial Sequence
  Synthetic polynucleotide
aaatctcatactcattcctggatgctttctcgggtccttcagatgaaggcgaaat

SEQ ID NO: 3871 - DNA, 55 bp, Artificial Sequence
  Synthetic polynucleotide
acacgtcttcaatcagcttcttccacttcatggctctcccgtactttatagggat

SEQ ID NO: 3872 - DNA, 55 bp, Artificial Sequence
  Synthetic polynucleotide
tacgttcatttaaccccgctttagttgttacgggtccggtcccattggtttctta

SEQ ID NO: 3873 - DNA, 55 bp, Artificial Sequence
  Synthetic polynucleotide
cgtcagttaattcgaaccctcctctaattctggttcacctactccaagagggata

SEQ ID NO: 3874 - DNA, 55 bp, Artificial Sequence
  Synthetic polynucleotide
caaattataggctaagctcctcatctttaccggctctacatccatttctcaccct

SEQ ID NO: 3875 - DNA, 55 bp, Artificial Sequence
  Synthetic polynucleotide
ttcattatctatgttgcagggatgtggtctaggtaggaccttacgtgatgcgatt

SEQ ID NO: 3876 - DNA, 55 bp, Artificial Sequence
  Synthetic polynucleotide
aggttagatccaaatccacctccatcgttgcggaccccaaatatcacaacagaat

SEQ ID NO: 3877 - DNA, 55 bp, Artificial Sequence
  Synthetic polynucleotide
atgatgatatcttggcccagaagctaggtgaggccatatgagctaagtattgagc

SEQ ID NO: 3878 - DNA, 55 bp, Artificial Sequence
  Synthetic polynucleotide
gagtaccacaaggggacttacatagtacaagggatagaggggtaggtaatgctaa

SEQ ID NO: 3879 - DNA, 55 bp, Artificial Sequence
  Synthetic polynucleotide
agtcggagctgaagttcagaacagtaaggtcggaagttacagctaaagccatatg

SEQ ID NO: 3880 - DNA, 55 bp, Artificial Sequence
  Synthetic polynucleotide
aataggctcaaatctccgttaaggtccaatcggcgtgtctctaagaaaaatctcg

SEQ ID NO: 3881 - DNA, 55 bp, Artificial Sequence
  Synthetic polynucleotide
tgaaatcatagtaactcaatccacgacaacaggcatcccaactcactctctcgag

SEQ ID NO: 3882 - DNA, 55 bp, Artificial Sequence
  Synthetic polynucleotide
ttaatagttacagtaccggagacatagaggcggttttcgaggggtacatagagct

SEQ ID NO: 3883 - DNA, 55 bp, Artificial Sequence
  Synthetic polynucleotide
aaattacgagaaagggctctagaaagtgaggggatttggacccataagtttagag

SEQ ID NO: 3884 - DNA, 55 bp, Artificial Sequence
  Synthetic polynucleotide
ttgaggcaacctggggcgagtcgtgattctgggtgttatacgaggtgtctccacg

SEQ ID NO: 3885 - DNA, 55 bp, Artificial Sequence
  Synthetic polynucleotide
aagctgggtaagaggccggtcacgagttctgggcccccaaactttcaaatagggg

SEQ ID NO: 3886 - DNA, 55 bp, Artificial Sequence
  Synthetic polynucleotide
tcctttgggcacatggcgcatctgatctttgggcacattatgacttcccactacc

SEQ ID NO: 3887 - DNA, 55 bp, Artificial Sequence
  Synthetic polynucleotide
aatttccagggtgcatcctcatcggttccttggcacgccgttctttatgcgagag

SEQ ID NO: 3888 - DNA, 55 bp, Artificial Sequence
  Synthetic polynucleotide
aaggtgtggcgcgctccgtaatcagcctctcggctcttgctgacacaatggctcc

SEQ ID NO: 3889 - DNA, 55 bp, Artificial Sequence
  Synthetic polynucleotide
agacatggcggggaatccctaaggtcattacgggccagtgccattacctttgcct

SEQ ID NO: 3890 - DNA, 55 bp, Artificial Sequence
  Synthetic polynucleotide
gaccaacgtccgcttgcggggattaggtcatggcaatcgtaagggagtcgttact

SEQ ID NO: 3891 - DNA, 55 bp, Artificial Sequence
  Synthetic polynucleotide
ttgacttcacctgcggcagcgggttgtcactggccgctatggacgttggagcttt

SEQ ID NO: 3892 - DNA, 55 bp, Artificial Sequence
  Synthetic polynucleotide
tcctccgagcactcttctcctcgagatgtccggccacagctcgtccaatatccta

SEQ ID NO: 3893 - DNA, 55 bp, Artificial Sequence
  Synthetic polynucleotide
tgctccggtttccgccctaatagtagcgtccggtatggaagcccctaccatgaaa

SEQ ID NO: 3894 - DNA, 55 bp, Artificial Sequence
  Synthetic polynucleotide
cgtaccagcagggcgccgccttcatactgtaggcgccgggaccaagctgatataa

SEQ ID NO: 3895 - DNA, 55 bp, Artificial Sequence
  Synthetic polynucleotide
gcctgtctatttatcgcgaggccccgttgtgggagcacgggtcccccagttcatt

SEQ ID NO: 3896 - DNA, 55 bp, Artificial Sequence
  Synthetic polynucleotide
ttggtcagtcggatgactgatactcccgggcgggaaccggttccccgtaaaactc

SEQ ID NO: 3897 - DNA, 55 bp, Artificial Sequence
  Synthetic polynucleotide
tagtctcaacgactggcgacggatatccgttgggaccctgataagacgttacagc

SEQ ID NO: 3898 - DNA, 55 bp, Artificial Sequence
  Synthetic polynucleotide
ccgagtagagggctcactactgaccaacggagggggtgacaagcggcgaaaaacg

SEQ ID NO: 3899 - DNA, 55 bp, Artificial Sequence
  Synthetic polynucleotide
atgctggcggcctcgccccgcgtcctagctcgggcattacgtctacatctcaagg

SEQ ID NO: 3900 - DNA, 55 bp, Artificial Sequence
  Synthetic polynucleotide
gacgggcgacggacggcccgcttgcttactcggcgttatcagtcctaggcacaat

SEQ ID NO: 3901 - DNA, 55 bp, Artificial Sequence
  Synthetic polynucleotide
gggacgggccctgaggctgtttggtttgcagggcagcactggcggactgcggcaa

SEQ ID NO: 3902 - DNA, 55 bp, Artificial Sequence
  Synthetic polynucleotide
agtttctccgaggtgaccgtcgggtgctcttggcccgcctcctcgcccctagagg

SEQ ID NO: 3903 - DNA, 55 bp, Artificial Sequence
  Synthetic polynucleotide
gacgctatccagcttcctggccgctcgccaaggtgtgtctccgaagaccgaagtc

SEQ ID NO: 3904 - DNA, 55 bp, Artificial Sequence
  Synthetic polynucleotide
ctctagggaagcagggcccccccaaaattgggggaaagccccttcgctaaaccgc

SEQ ID NO: 3905 - DNA, 55 bp, Artificial Sequence
  Synthetic polynucleotide
ccggcagagcgacgcacgcgcgaacgatttcggctaccgcgtcgctatacgattt

SEQ ID NO: 3906 - DNA, 55 bp, Artificial Sequence
  Synthetic polynucleotide
ccgcggatcgtccgcccgcacgccccgaatggggcgacgaagacggtactagtcc

SEQ ID NO: 3907 - DNA, 55 bp, Artificial Sequence
  Synthetic polynucleotide
ctgacggctcgggaagccggagctcggcactggttgcgcagctgaagtcgggcga

SEQ ID NO: 3908 - DNA, 55 bp, Artificial Sequence
  Synthetic polynucleotide
gaggcgagtgcaccagcctggttgagtcgccggcaacgatgtgggggtgatcggt

SEQ ID NO: 3909 - DNA, 55 bp, Artificial Sequence
  Synthetic polynucleotide
ggaaggcgtgccggagccgatgtcagcgaatgggaccgcctcctgaccggaacac

SEQ ID NO: 3910 - DNA, 55 bp, Artificial Sequence
  Synthetic polynucleotide
aactggtactgcaggtctacccgctccagacgggggccgggaagagtctcgtttc

SEQ ID NO: 3911 - DNA, 55 bp, Artificial Sequence
  Synthetic polynucleotide
cgagtaccgaatccaacgagtaacgtgcaggggccggctccgcgagtgaagcgat

SEQ ID NO: 3912 - DNA, 55 bp, Artificial Sequence
  Synthetic polynucleotide
cggtaatgtaactcgaccagagtgccagacgggatcgcagacgcccggtgggagc

SEQ ID NO: 3913 - DNA, 55 bp, Artificial Sequence
  Synthetic polynucleotide
ccccccagtaggcctgcccctatgaacggccggcggtggttacccgttgattgaa

SEQ ID NO: 3914 - DNA, 55 bp, Artificial Sequence
  Synthetic polynucleotide
ttattttaaaattaatcaaatccgttattttggcaaaattaatcaacgtgttccg

SEQ ID NO: 3915 - DNA, 55 bp, Artificial Sequence
  Synthetic polynucleotide
tccaatgcatgaattgctttactttctttatggcatatatcttttctctgatatt

SEQ ID NO: 3916 - DNA, 55 bp, Artificial Sequence
  Synthetic polynucleotide
gagcattttttattaccactttattaattgtggtttttacattattttgtttttt

SEQ ID NO: 3917 - DNA, 55 bp, Artificial Sequence
  Synthetic polynucleotide
cactaaatatagatgacctgaaaaaaatttaggaatttaaaaaaataataattac

SEQ ID NO: 3918 - DNA, 55 bp, Artificial Sequence
  Synthetic polynucleotide
ttataactagtctctccttaaaaaataaagtggtgtaaaatttaataaaatttct

SEQ ID NO: 3919 - DNA, 55 bp, Artificial Sequence
  Synthetic polynucleotide
tcgataaagtttgtggcatttgtagaaatatgggtgtgttaaaagagaattacga

SEQ ID NO: 3920 - DNA, 55 bp, Artificial Sequence
  Synthetic polynucleotide
aaagtttaagttggggcagaagtaaaaaataggggtcaacttaacattaaatgca

SEQ ID NO: 3921 - DNA, 55 bp, Artificial Sequence
  Synthetic polynucleotide
tatgtttaatctgggtcaatagtaagttattgggaggagtaaataagaatacatg

SEQ ID NO: 3922 - DNA, 55 bp, Artificial Sequence
  Synthetic polynucleotide
aaattatcgaagaatacaccactaaaaaagaggaataaataaataaactcataag

SEQ ID NO: 3923 - DNA, 55 bp, Artificial Sequence
  Synthetic polynucleotide
tcctcaattaagattacgaggtaaaactagcggattaagtaactacaaaaattct

SEQ ID NO: 3924 - DNA, 55 bp, Artificial Sequence
  Synthetic polynucleotide
tccagctgttgttagtcttaaaaaaacaagtggttaaattgagaaaacaagatgt

SEQ ID NO: 3925 - DNA, 55 bp, Artificial Sequence
  Synthetic polynucleotide
tttgttgatccttgttcacaaaaaaaatgaaggttccaaaaagatagatagtaat

SEQ ID NO: 3926 - DNA, 55 bp, Artificial Sequence
  Synthetic polynucleotide
actttctacggggtttctaaaaacgaagggaggtattataaaataaaaagaaaaa

SEQ ID NO: 3927 - DNA, 55 bp, Artificial Sequence
  Synthetic polynucleotide
taaaaaattaagtagacagttaaaaaacgaaggttttaaccccaagtaaaaatct

SEQ ID NO: 3928 - DNA, 55 bp, Artificial Sequence
  Synthetic polynucleotide
ctaacagtattgcaaacgagaaaatcgaaggggttgctaaaaaaaaatatgacat

SEQ ID NO: 3929 - DNA, 55 bp, Artificial Sequence
  Synthetic polynucleotide
acaataggggccttagcatactaattatatggggggccttcaatatatacacaaa

SEQ ID NO: 3930 - DNA, 55 bp, Artificial Sequence
  Synthetic polynucleotide
aaattttgattgggggctgtgcataattatgggtattgtatggccacagaaaatc

SEQ ID NO: 3931 - DNA, 55 bp, Artificial Sequence
  Synthetic polynucleotide
ggatggccgtggaattcatgtttcttattggggtgatgttatttaatttaccgta

SEQ ID NO: 3932 - DNA, 55 bp, Artificial Sequence
  Synthetic polynucleotide
aattttttttttgcatcaacaatcatcttttgggtccctagatcaagcaatcgga

SEQ ID NO: 3933 - DNA, 55 bp, Artificial Sequence
  Synthetic polynucleotide
cgataggctcaaaaaccgcataaataaaacaggctaaaaagcataacctgccaag

SEQ ID NO: 3934 - DNA, 55 bp, Artificial Sequence
  Synthetic polynucleotide
tcataacggacgagggcataaaaaaaatacgggaaggaacagaagaactatatgc

SEQ ID NO: 3935 - DNA, 55 bp, Artificial Sequence
  Synthetic polynucleotide
tgagaatcaaagaactcccctacttaaagaaggtcaactcccttatcaccaagta

SEQ ID NO: 3936 - DNA, 55 bp, Artificial Sequence
  Synthetic polynucleotide
gttcctaatagatgagcaaacaaagcaatacggaaattgcctgcaaacaaccgaa

SEQ ID NO: 3937 - DNA, 55 bp, Artificial Sequence
  Synthetic polynucleotide
tgaaatgataagatgactcccgaagaaaattggataaacctgaagagaatgtagg

SEQ ID NO: 3938 - DNA, 55 bp, Artificial Sequence
  Synthetic polynucleotide
tcaaatatgaagatgccggtaatttgtgaagggatccgatgcgtatttgtttctg

SEQ ID NO: 3939 - DNA, 55 bp, Artificial Sequence
  Synthetic polynucleotide
gaacggagccaagtcactaaaatccaagaagggtcacacatcaaaaaaactttta

SEQ ID NO: 3940 - DNA, 55 bp, Artificial Sequence
  Synthetic polynucleotide
taaaactaaaaaaaacccgtactgagcaaaaggggaaagggcccttaataactgc

SEQ ID NO: 3941 - DNA, 55 bp, Artificial Sequence
  Synthetic polynucleotide
ttgtggtggttacatccaagtataaagtggtgggaactatcgaattataaagcac

SEQ ID NO: 3942 - DNA, 55 bp, Artificial Sequence
  Synthetic polynucleotide
ctgtcgatgtaacaaccttaaaacccccgaaggtaataacaatctttaccccaaa

SEQ ID NO: 3943 - DNA, 55 bp, Artificial Sequence
  Synthetic polynucleotide
ttgttactttgcagtacgagatgactgcgtaggattcatgagatgaactatttcg

SEQ ID NO: 3944 - DNA, 55 bp, Artificial Sequence
  Synthetic polynucleotide
gaaacttatgtagttccaacttgcctttcgagggttgttccccttgaagagtact

SEQ ID NO: 3945 - DNA, 55 bp, Artificial Sequence
  Synthetic polynucleotide
tttttgtagggcttggctgtctaattattttggggaaggtcgaacgtattagcca

SEQ ID NO: 3946 - DNA, 55 bp, Artificial Sequence
  Synthetic polynucleotide
tgaacgaaatgggtggctcgtttcttattggggattgctaagacggtaacttaac

SEQ ID NO: 3947 - DNA, 55 bp, Artificial Sequence
  Synthetic polynucleotide
taaatctcgaggggtacggctttcgttctggggatttgtaatctttggtaaatgt

SEQ ID NO: 3948 - DNA, 55 bp, Artificial Sequence
  Synthetic polynucleotide
gaatgggggcaaaggccgtcgtttattctagggaggattgttattactattccct

SEQ ID NO: 3949 - DNA, 55 bp, Artificial Sequence
  Synthetic polynucleotide
agattagcgggctttacatcctgtacttaggggcacagaactacactgttaatat

SEQ ID NO: 3950 - DNA, 55 bp, Artificial Sequence
  Synthetic polynucleotide
gcatttttattggggccgttcttatccaattggttgggccgatatagacgtagga

SEQ ID NO: 3951 - DNA, 55 bp, Artificial Sequence
  Synthetic polynucleotide
gagtatacattctggactcgcggaaaactaaggtagagaactggaaaaggaaagg

SEQ ID NO: 3952 - DNA, 55 bp, Artificial Sequence
  Synthetic polynucleotide
gcatttttattggatactcttgccgaaggggggacttggaaaagcgtgtgaaata

SEQ ID NO: 3953 - DNA, 55 bp, Artificial Sequence
  Synthetic polynucleotide
tgcataactcattaccctacacagagtctctggaacacctacacaatacgtgacc

SEQ ID NO: 3954 - DNA, 55 bp, Artificial Sequence
  Synthetic polynucleotide
tgtttttattaaggagcgagcatttagggtggggaggatatgcgatttagcaaag

SEQ ID NO: 3955 - DNA, 55 bp, Artificial Sequence
  Synthetic polynucleotide
ggtctattcggggactcacaaaaactggaggggagcaactacatatagaatagta

SEQ ID NO: 3956 - DNA, 55 bp, Artificial Sequence
  Synthetic polynucleotide
attgtacggtttgcgacgaagagactgcggggggttagatctagttaattaaaag

SEQ ID NO: 3957 - DNA, 55 bp, Artificial Sequence
  Synthetic polynucleotide
tctgggggatgaagagctgatatgcacaaggggagttgatttaagtgagattaca

SEQ ID NO: 3958 - DNA, 55 bp, Artificial Sequence
  Synthetic polynucleotide
attttgttcgtacggccagagatagagggttggcgttaaagagttcatcattcac

SEQ ID NO: 3959 - DNA, 55 bp, Artificial Sequence
  Synthetic polynucleotide
aggaccggatggtacgcggggtgctaatttaggacagggtcaggcatcgtaccga

SEQ ID NO: 3960 - DNA, 55 bp, Artificial Sequence
  Synthetic polynucleotide
tatgatcggtaggcagctctccgaatttcatgggcgtctctcgagttgatctgca

SEQ ID NO: 3961 - DNA, 55 bp, Artificial Sequence
  Synthetic polynucleotide
agagttaaccatggagccccccctttctctgggggagaattgacccttgatccag

SEQ ID NO: 3962 - DNA, 55 bp, Artificial Sequence
  Synthetic polynucleotide
tcatacatgggttggtctggtactcgcccagggaggacaactaagagatcggtgt

SEQ ID NO: 3963 - DNA, 55 bp, Artificial Sequence
  Synthetic polynucleotide
ctttgactttgtaggtcatcccgtgcatttggggtttggggcaggacccgtcgat

SEQ ID NO: 3964 - DNA, 55 bp, Artificial Sequence
  Synthetic polynucleotide
tggctccgagctccccccatgcgagtatataggctgcccggaatcgagctagagt

SEQ ID NO: 3965 - DNA, 55 bp, Artificial Sequence
  Synthetic polynucleotide
cacatggcgcggggtccgtccccatcacacgggtgagtgttttattaagtcccca

SEQ ID NO: 3966 - DNA, 55 bp, Artificial Sequence
  Synthetic polynucleotide
aaatagaggtggctatccgttccgtgcgaaggggtaggctattgggttcccttct

SEQ ID NO: 3967 - DNA, 55 bp, Artificial Sequence
  Synthetic polynucleotide
tttcgagcggtcggggctcatgccagtaacggggggaaaatttgggattgggcat

SEQ ID NO: 3968 - DNA, 55 bp, Artificial Sequence
  Synthetic polynucleotide
caatgtgacaatgggtccggacattgatagggggcaggagggggtataagatgga

SEQ ID NO: 3969 - DNA, 55 bp, Artificial Sequence
  Synthetic polynucleotide
gtgacctcagcgctagcatgaactacccagagggcggcgcatatttgacccggat

SEQ ID NO: 3970 - DNA, 55 bp, Artificial Sequence
  Synthetic polynucleotide
gggtcatcaggttcaaccccgatccgttgcaggggaccccaggattcgtgaattc

SEQ ID NO: 3971 - DNA, 55 bp, Artificial Sequence
  Synthetic polynucleotide
tagacggccaggtacccctacacgcacgggaggtacccaatccgatatcgcttga

SEQ ID NO: 3972 - DNA, 55 bp, Artificial Sequence
  Synthetic polynucleotide
gtgcagggggtacggacgactcttaaccagaggggccctctacgcgtttcatctc

SEQ ID NO: 3973 - DNA, 55 bp, Artificial Sequence
  Synthetic polynucleotide
agacttatcctatccgcgagaatagacacccggcgtacagaaggacgccatggag

SEQ ID NO: 3974 - DNA, 55 bp, Artificial Sequence
  Synthetic polynucleotide
ggtctcccgctcgcggccaccaccagttctcgggattcacccgctaactctgtga

SEQ ID NO: 3975 - DNA, 55 bp, Artificial Sequence
  Synthetic polynucleotide
aatgtctagggtcgctcggatcacgcgcctgggtgtgcctcattgcgcctatgcg

SEQ ID NO: 3976 - DNA, 55 bp, Artificial Sequence
  Synthetic polynucleotide
cggggagccgcgggctctgactctgtatttgggggcgcccccgctccggaacatt

SEQ ID NO: 3977 - DNA, 55 bp, Artificial Sequence
  Synthetic polynucleotide
ttcctcgagcgctcgcccagctcgagtttggggaaacgcgcagcgagggtaggca

SEQ ID NO: 3978 - DNA, 55 bp, Artificial Sequence
  Synthetic polynucleotide
cgattctcgaccttgtccgcggcgattatgtgggttaagcgcgcggcggcagcta

SEQ ID NO: 3979 - DNA, 55 bp, Artificial Sequence
  Synthetic polynucleotide
ggggacggggtcagcacggggtctttcttgtggctggacgttcctcctccaccgc

SEQ ID NO: 3980 - DNA, 55 bp, Artificial Sequence
  Synthetic polynucleotide
tggcacttctggagggccgatctaaactatgggggccctcggcgctcccggataa

SEQ ID NO: 3981 - DNA, 55 bp, Artificial Sequence
  Synthetic polynucleotide
accgtggggtgggcgtcgccggcgctcgagagggagaatcgacgcgaattctgta

SEQ ID NO: 3982 - DNA, 55 bp, Artificial Sequence
  Synthetic polynucleotide
cggttgcacccgggggccgcggactctgtatgggtgggcagtacacaccatatct

SEQ ID NO: 3983 - DNA, 55 bp, Artificial Sequence
  Synthetic polynucleotide
cgctgttacaagaccccctccccaacggattggtagtgcccctagaaggtggccc

SEQ ID NO: 3984 - DNA, 55 bp, Artificial Sequence
  Synthetic polynucleotide
acgaatccgaggcccgccccattgaagcgggggttcaatgacgcccctagtcgag

SEQ ID NO: 3985 - DNA, 55 bp, Artificial Sequence
  Synthetic polynucleotide
gacgacacattggctaccaccccgtcggactggggggccctggtataagcacaag

SEQ ID NO: 3986 - DNA, 55 bp, Artificial Sequence
  Synthetic polynucleotide
gcgctcgcgcgtagatccagccacccacggaggtacttgccaagattctgcccgt

SEQ ID NO: 3987 - DNA, 55 bp, Artificial Sequence
  Synthetic polynucleotide
atctgatcagggcacccccatcaatccaggcggagtgtcggccccgcggctctta

SEQ ID NO: 3988 - DNA, 55 bp, Artificial Sequence
  Synthetic polynucleotide
ggatcctcggggagagcaactaacaccagtcgggagcgaggagacactgacgccc

SEQ ID NO: 3989 - DNA, 55 bp, Artificial Sequence
  Synthetic polynucleotide
aggccagcaggctgatgtagtcactcttgagggccagcgtccagatgcccactgc

SEQ ID NO: 3990 - DNA, 55 bp, Artificial Sequence
  Synthetic polynucleotide
gccactacacagatgcaggctgcagatgcccggaagtccttcccatgcttcgatg

SEQ ID NO: 3991 - DNA, 55 bp, Artificial Sequence
  Synthetic polynucleotide
agtcccagcaggccctcggcggcggctcccagggagcgtcccggaaccggggcgg

SEQ ID NO: 3992 - DNA, 55 bp, Artificial Sequence
  Synthetic polynucleotide
ggaagccagcacagaacatgttgttatagatggtgaactttgtagatcgaagaca

SEQ ID NO: 3993 - DNA, 55 bp, Artificial Sequence
  Synthetic polynucleotide
acgctctggaacagattctggaaagctcctcggtaggtcttggacggcggccgag

SEQ ID NO: 3994 - DNA, 55 bp, Artificial Sequence
  Synthetic polynucleotide
catgtggctcggtcaacaagtggaactctaaggtactgaagaactaaagctgatc

SEQ ID NO: 3995 - DNA, 55 bp, Artificial Sequence
  Synthetic polynucleotide
cactcccgccggagtatttcaggggctcttgggaaactccttcatacatcagccc

SEQ ID NO: 3996 - DNA, 55 bp, Artificial Sequence
  Synthetic polynucleotide
atggtcctctgggagggctgtgctgctagtgggtacctcagtcacacacccccaa

SEQ ID NO: 3997 - DNA, 55 bp, Artificial Sequence
  Synthetic polynucleotide
caatgttcacgcaacttgaaattatatctgtggtcttcaaattgtcttttgtcat

SEQ ID NO: 3998 - DNA, 55 bp, Artificial Sequence
  Synthetic polynucleotide
gactgctttggtagagaaagaagcagtgcctgggataaaggtatcttctcacttg

SEQ ID NO: 3999 - DNA, 55 bp, Artificial Sequence
  Synthetic polynucleotide
gtcacttaggataggagaagatgatgtatagggtttagtgggagatgttgcaagg

SEQ ID NO: 4000 - DNA, 55 bp, Artificial Sequence
  Synthetic polynucleotide
acttttaatagcatacagtgatttgatgaaaggacgtcaaacaatgtggcgatgt

SEQ ID NO: 4001 - DNA, 55 bp, Artificial Sequence
  Synthetic polynucleotide
ctgggatggtgggggccctcctcttgctgctggtggtggccctggggatcggcct

SEQ ID NO: 4002 - DNA, 55 bp, Artificial Sequence
  Synthetic polynucleotide
tagagagggtgaaaatcatcagttatcatcagggcaacaaattgctttctcctag

SEQ ID NO: 4003 - DNA, 55 bp, Artificial Sequence
  Synthetic polynucleotide
agcttctgggttcatgagtcttgacaacaacggtactgctaccccagagttacct

SEQ ID NO: 4004 - DNA, 55 bp, Artificial Sequence
  Synthetic polynucleotide
acatcctggtggtggcgggcactgtcgtcatggtgactggggtcttgggctgctg

SEQ ID NO: 4005 - DNA, 55 bp, Artificial Sequence
  Synthetic polynucleotide
ccccatggcaatgacagtgccaaagccagccgggccaggaccaaagccggtgatc

SEQ ID NO: 4006 - DNA, 55 bp, Artificial Sequence
  Synthetic polynucleotide
acctatgagcacagtagaactaagggtgggtggtgtagctaaagaacttgaccaa

SEQ ID NO: 4007 - DNA, 55 bp, Artificial Sequence
  Synthetic polynucleotide
ctaccctcggccgccgtccaagacctaccgaggagctttccagaatctgttccag

SEQ ID NO: 4008 - DNA, 55 bp, Artificial Sequence
  Synthetic polynucleotide
atgttggacagggctgtcaggtccttggggtggataagcgtgatgttgaactcgg

SEQ ID NO: 4009 - DNA, 55 bp, Artificial Sequence
  Synthetic polynucleotide
cgtgggctttaccatgagtaactccattcctggtatagaatccccatttgaacaa

SEQ ID NO: 4010 - DNA, 55 bp, Artificial Sequence
  Synthetic polynucleotide
cttccatgaaggaggtagagattcatgtcaaggagatagtgggggaccccatgtt

SEQ ID NO: 4011 - DNA, 55 bp, Artificial Sequence
  Synthetic polynucleotide
ttcaactttagaacgaatacagaaaagtaaaggacgtgcagaaaaaatcagacac

SEQ ID NO: 4012 - DNA, 55 bp, Artificial Sequence
  Synthetic polynucleotide
gagtagtcagatccgtggcccatcatgtcttggaaacgtttttgtccctgctgcc

SEQ ID NO: 4013 - DNA, 55 bp, Artificial Sequence
  Synthetic polynucleotide
actcgcttccggtggacaagcggcagatagcggaaagagccgcttcgtttcctgc

SEQ ID NO: 4014 - DNA, 55 bp, Artificial Sequence
  Synthetic polynucleotide
gaatgcacaagaactgcaaagtgaaacaaaaggaaataaaatccatgatgaacat

SEQ ID NO: 4015 - DNA, 55 bp, Artificial Sequence
  Synthetic polynucleotide
ctctgctggaactgacacgcagacattcagcggctccgccgccaatgcaaaactc

SEQ ID NO: 4016 - DNA, 55 bp, Artificial Sequence
  Synthetic polynucleotide
caggggcttccgaagctggaatctgctctctggaggcaaggctgcccaaacagcc

SEQ ID NO: 4017 - DNA, 55 bp, Artificial Sequence
  Synthetic polynucleotide
tgacccttgggaccagccggggcagtgaagcggaggtctttctctgcagaaggcc

SEQ ID NO: 4018 - DNA, 55 bp, Artificial Sequence
  Synthetic polynucleotide
ggatgctgaggagtatctggtaccccagcagggcttcttctgtccagaccctgcc

SEQ ID NO: 4019 - DNA, 55 bp, Artificial Sequence
  Synthetic polynucleotide
ggttcgggggctgggcaggcgacccgccgcaggtccccgggaggggcgaacgggc

SEQ ID NO: 4020 - DNA, 55 bp, Artificial Sequence
  Synthetic polynucleotide
agtactcggggttctccacggcacccccaaaggcaaaaacgtctttgacgacccc

SEQ ID NO: 4021 - DNA, 55 bp, Artificial Sequence
  Synthetic polynucleotide
gggtgcggaagagaaagaataccatgcagaaggaggcaaagtaaggaggtggctt

SEQ ID NO: 4022 - DNA, 55 bp, Artificial Sequence
  Synthetic polynucleotide
gcgcctccgcctcctcctctgctccgccaccggcttcctcctcctgagcagtcag

SEQ ID NO: 4023 - DNA, 55 bp, Artificial Sequence
  Synthetic polynucleotide
cgggctgactgctcaggaggaggaagccggtggcggagcagaggaggaggcggag

SEQ ID NO: 4024 - DNA, 55 bp, Artificial Sequence
  Synthetic polynucleotide
cgcgcccagggctgaggaggggtcgcggcgaggacagccgggactgggcgcaggc

SEQ ID NO: 4025 - DNA, 55 bp, Artificial Sequence
  Synthetic polynucleotide
atttctccctcaagctgtttgccaaagaggtggctccagtgcccaaaatccacta

SEQ ID NO: 4026 - DNA, 55 bp, Artificial Sequence
  Synthetic polynucleotide
aggtcgcggtgcacgcagcggcgggagcccaggtactccatgccctgcgggcggg

SEQ ID NO: 4027 - DNA, 55 bp, Artificial Sequence
  Synthetic polynucleotide
agcagctgccggcccccaagtggacagagctggccctgctgattcaacagtgcat

SEQ ID NO: 4028 - DNA, 55 bp, Artificial Sequence
  Synthetic polynucleotide
cgcaggatccggaagggctaggcgggggcgcggcggtgcagcctctcccgagcgc

SEQ ID NO: 4029 - DNA, 55 bp, Artificial Sequence
  Synthetic polynucleotide
gtcatataacgcaaataaccttctgtgtcatggcttggctaataagcatgcaatt

SEQ ID NO: 4030 - DNA, 55 bp, Artificial Sequence
  Synthetic polynucleotide
cagttcgtcagcaccaagtctgagtggaccaggataggagggagccccaagttcc

SEQ ID NO: 4031 - DNA, 55 bp, Artificial Sequence
  Synthetic polynucleotide
ggcatatggagcaggactcctttcctccattggagaattaaaggtatgaagctgt

SEQ ID NO: 4032 - DNA, 55 bp, Artificial Sequence
  Synthetic polynucleotide
ctgtggcactgctgcgcctctgctgcgcctcgggtgtcttttgcggcggtgggtc

SEQ ID NO: 4033 - DNA, 55 bp, Artificial Sequence
  Synthetic polynucleotide
tattggagttgaagccagctgattataagatggtttcctttgtggagttttaaat

SEQ ID NO: 4034 - DNA, 55 bp, Artificial Sequence
  Synthetic polynucleotide
cttactccggccaaaaaagaactgcacctctggagcgggttagtggtggtggtag

SEQ ID NO: 4035 - DNA, 55 bp, Artificial Sequence
  Synthetic polynucleotide
ttgtcagtgagttcgactacgtggagaagcaggcatccaatggtgtcttggtatg

SEQ ID NO: 4036 - DNA, 55 bp, Artificial Sequence
  Synthetic polynucleotide
ccggaagaagcgaccaaagcgcctgaggaccggcaacatggtgcggtcggggaat

SEQ ID NO: 4037 - DNA, 55 bp, Artificial Sequence
  Synthetic polynucleotide
caggcacctacctggccacagcctacatcctggtggtggcgggcactgtcgtcat

SEQ ID NO: 4038 - DNA, 55 bp, Artificial Sequence
  Synthetic polynucleotide
tggtacagatggcactgacaatcccctttctggtggggatcagtatcagaacatc

SEQ ID NO: 4039 - DNA, 55 bp, Artificial Sequence
  Synthetic polynucleotide
gtgctaaaatgaggagctccaagaagactgaggtgaacctggaggcccctgagcc

SEQ ID NO: 4040 - DNA, 55 bp, Artificial Sequence
  Synthetic polynucleotide
agaaggcagcgaagaagacaaatcacaaactggtgtgaatagagccagcaaagga

SEQ ID NO: 4041 - DNA, 55 bp, Artificial Sequence
  Synthetic polynucleotide
ccgggcggagggggcgggaagagcgcgtcctggccaagccgagtagtgtcttcca

SEQ ID NO: 4042 - DNA, 55 bp, Artificial Sequence
  Synthetic polynucleotide
gaaattgttcctcgtctgataagacaacagtggagagtatgcatttatttattta

SEQ ID NO: 4043 - DNA, 55 bp, Artificial Sequence
  Synthetic polynucleotide
acaaactggtgtgaatagagccagcaaaggaggtcttatctatgggaactacctg

SEQ ID NO: 4044 - DNA, 55 bp, Artificial Sequence
  Synthetic polynucleotide
cacgcacgcagactcgcagacgccctctgctggaactgacacgcagacattcagc

SEQ ID NO: 4045 - DNA, 55 bp, Artificial Sequence
  Synthetic polynucleotide
catgcgtggattgtcgtcttctgtccaagttggtcgcttccctgcgccaaaggta

SEQ ID NO: 4046 - DNA, 55 bp, Artificial Sequence
  Synthetic polynucleotide
aggcgcagcagaggcgcagcagtgccacagcggctccgcctctgccgcctagttt

SEQ ID NO: 4047 - DNA, 55 bp, Artificial Sequence
  Synthetic polynucleotide
ctaggtgaacggccatggcgggctggatccaggcccagcagctgcagggagacgc

SEQ ID NO: 4048 - DNA, 55 bp, Artificial Sequence
  Synthetic polynucleotide
cctgtgtctggagccaagatggggctctgcaggacacttcctgccaagtccatgc

SEQ ID NO: 4049 - DNA, 55 bp, Artificial Sequence
  Synthetic polynucleotide
tttggaaagggggtggggggagtttgctcctggaccccctatttctgacctccca

SEQ ID NO: 4050 - DNA, 55 bp, Artificial Sequence
  Synthetic polynucleotide
aggtggcaccgccgaggctgctggaggaagtggccgagcagtgccacggccccat

SEQ ID NO: 4051 - DNA, 55 bp, Artificial Sequence
  Synthetic polynucleotide
cgccgccaatgcaaaactcaaccctaccccaggcagcaatgctatctcaggtttg

SEQ ID NO: 4052 - DNA, 55 bp, Artificial Sequence
  Synthetic polynucleotide
cagcaggtatgaatccatcttcctgacccttgggaccagccggggcagtgaagcg

SEQ ID NO: 4053 - DNA, 55 bp, Artificial Sequence
  Synthetic polynucleotide
gcatgaactgctaggtgatgatgtcagattcggttttactaacttctccaaaaat

SEQ ID NO: 4054 - DNA, 55 bp, Artificial Sequence
  Synthetic polynucleotide
gaccctgagggagcagagatgtgggaatgggggccgagccaattgtgatgtaagt

SEQ ID NO: 4055 - DNA, 55 bp, Artificial Sequence
  Synthetic polynucleotide
caggatcagggggactggggtcgggagggtggggcaggaaggaagccagaatcag

SEQ ID NO: 4056 - DNA, 55 bp, Artificial Sequence
  Synthetic polynucleotide
atttttgaatgagaaagctggagaagggggaggagtgatccaggtaaggtgggag

SEQ ID NO: 4057 - DNA, 55 bp, Artificial Sequence
  Synthetic polynucleotide
cttacctttggcgcagggaagcgaccaacttggacagaagacgacaatccacgca

SEQ ID NO: 4058 - DNA, 55 bp, Artificial Sequence
  Synthetic polynucleotide
cctcatggaagaagagggggagagagttacaggttggacatgatgcacactatgg

SEQ ID NO: 4059 - DNA, 55 bp, Artificial Sequence
  Synthetic polynucleotide
agatatcatggtggaagagtttgtggaagggggtcctctggatctcttcatgcac

SEQ ID NO: 4060 - DNA, 55 bp, Artificial Sequence
  Synthetic polynucleotide
gatgagttgcagttcccagctgcacgcctcgggaagcgccgcactctccttaggg

SEQ ID NO: 4061 - DNA, 55 bp, Artificial Sequence
  Synthetic polynucleotide
ggaaatgcaagaagagggaaacgtgtggcttggagtttcaagaagagtgactgtc

SEQ ID NO: 4062 - DNA, 55 bp, Artificial Sequence
  Synthetic polynucleotide
agcatgtccaggtgggtctcgggactggcagggagccgcagcttcatgtctgtgc

SEQ ID NO: 4063 - DNA, 55 bp, Artificial Sequence
  Synthetic polynucleotide
atcaggacgagaatgagggtcctttgggaaaggagaagttaagcaacatctagca

SEQ ID NO: 4064 - DNA, 55 bp, Artificial Sequence
  Synthetic polynucleotide
cccggtgattggtgggggcggaagggggccgggcgccagcgctgccttttctcct

SEQ ID NO: 4065 - DNA, 55 bp, Artificial Sequence
  Synthetic polynucleotide
ccgcgcgcagcggccagagaccgagccctaaggagagtgcggcgcttcccgaggc

SEQ ID NO: 4066 - DNA, 55 bp, Artificial Sequence
  Synthetic polynucleotide
cagcacactggttgtggcagcagtcactgggggacttgccacggcagcgcccgga

SEQ ID NO: 4067 - DNA, 55 bp, Artificial Sequence
  Synthetic polynucleotide
aactgttcaacaacagcagcagccacctggaggactacagtggcctgtccgtgtc

SEQ ID NO: 4068 - DNA, 55 bp, Artificial Sequence
  Synthetic polynucleotide
tggagcccctggagccagcccctggccttcaggacaaagcctgcaggtactggtg

SEQ ID NO: 4069 - DNA, 55 bp, Artificial Sequence
  Synthetic polynucleotide
ccctggttggtcccaaaggcggagggcgttaggagggaggctgggttgccgccgt

SEQ ID NO: 4070 - DNA, 55 bp, Artificial Sequence
  Synthetic polynucleotide
aggaagggcctgagtccgagcagaagaagaagggctcccatcacatcaaccggtg

SEQ ID NO: 4071 - DNA, 55 bp, Artificial Sequence
  Synthetic polynucleotide
ggaagggcctgagtccgagcagaagaagaagggctcccatcacatcaaccggtgg

SEQ ID NO: 4072 - DNA, 55 bp, Artificial Sequence
  Synthetic polynucleotide
ccttcttcgaggcagccagcatgatgagacaggtctcccacaaacacatcgtgta

SEQ ID NO: 4073 - DNA, 55 bp, Artificial Sequence
  Synthetic polynucleotide
tggttatcaccttctttgcttgttcaaatggggattctataccaggaatggagtt

SEQ ID NO: 4074 - DNA, 55 bp, Artificial Sequence
  Synthetic polynucleotide
gtctcaaggagcagggtgagtgtctcagcctggccgtgttggacctggcccggat

SEQ ID NO: 4075 - DNA, 55 bp, Artificial Sequence
  Synthetic polynucleotide
cccgagccaggaactgtgtgtgttgcaggggggcagtaactccccaactccctcg

SEQ ID NO: 4076 - DNA, 55 bp, Artificial Sequence
  Synthetic polynucleotide
aggccatggagggctgagagagggacaagtcggaaccattttaaagctcagcccc

SEQ ID NO: 4077 - DNA, 55 bp, Artificial Sequence
  Synthetic polynucleotide
agcagggacaaaaacgtttccaagacatgatgggccacggatctgactactcact

SEQ ID NO: 4078 - DNA, 55 bp, Artificial Sequence
  Synthetic polynucleotide
cgggcgcgtgccacgcccgcggggtgaagtcggagcgcggggcctgctggagaga

SEQ ID NO: 4079 - DNA, 55 bp, Artificial Sequence
  Synthetic polynucleotide
tgctgtgactgcttgcagatggccatggcgcggacgcgggtgccgggcgggggtg

SEQ ID NO: 4080 - DNA, 55 bp, Artificial Sequence
  Synthetic polynucleotide
atgacctgcagaagcgcctggcagtgtaccaggccggggcccgcgagggcgccga

SEQ ID NO: 4081 - DNA, 55 bp, Artificial Sequence
  Synthetic polynucleotide
ccccttggcagtcatcttagtcattacctgaggtgttcgttgtaactcatataaa

SEQ ID NO: 4082 - DNA, 55 bp, Artificial Sequence
  Synthetic polynucleotide
ttctcatctgtgcccctccctccctggcccaggtgaaggtgtggttccagaaccg

SEQ ID NO: 4083 - DNA, 55 bp, Artificial Sequence
  Synthetic polynucleotide
catgtctgacagagccccccctcaaagagagggtggaaggacacggggtttttcc

SEQ ID NO: 4084 - DNA, 55 bp, Artificial Sequence; identical to SEQ ID NO: 4071
  Synthetic polynucleotide

SEQ ID NO: 4085 - DNA, 55 bp, Artificial Sequence
  Synthetic polynucleotide
cgcacctcatggaatcccttctgcagcacctggatcgcttttccgagcttctggc

SEQ ID NO: 4086 - DNA, 55 bp, Artificial Sequence
  Synthetic polynucleotide
aaggaaactggaacacaaagcatagactgcggggcgggccagcctgaatagctgc

SEQ ID NO: 4087 - DNA, 55 bp, Artificial Sequence
  Synthetic polynucleotide
caatccttggggcccagactgagcacgtgatggcagaggaaaggaagccctgctt

SEQ ID NO: 4088 - DNA, 55 bp, Artificial Sequence
  Synthetic polynucleotide
gcgccccggtggcactgcggctggaggtgggggttaaagcggagactctggtgct

SEQ ID NO: 4089 - DNA, 55 bp, Artificial Sequence
  Synthetic polynucleotide
gcttttgtgcagcagcagcagcagcagcagcggcagcagcagcagtatagaggaa

SEQ ID NO: 4090 - DNA, 55 bp, Artificial Sequence
  Synthetic polynucleotide
tagttggccgatcagcagcagcagcagcagcggcagcagcagcagcttcaggttc

SEQ ID NO: 4091 - DNA, 55 bp, Artificial Sequence
  Synthetic polynucleotide
gttaaaatccagcagcagcagcagcagcagcggcagcagcagcagcagttgttat

SEQ ID NO: 4092 - DNA, 55 bp, Artificial Sequence
  Synthetic polynucleotide
taatggcagcagcagcagcagcagcagcagcggcagcagcagcagcagcagtcgt

SEQ ID NO: 4093 - DNA, 55 bp, Artificial Sequence
  Synthetic polynucleotide
aactccccgcgtccctcttgacagcagcagcggcagcagcagtggatcacgcatg

SEQ ID NO: 4094 - DNA, 55 bp, Artificial Sequence
  Synthetic polynucleotide
ttgtggtttacactggacatggaaatagagaggagcaaaatctgtccgatctact

SEQ ID NO: 4095 - DNA, 55 bp, Artificial Sequence
  Synthetic polynucleotide
caagcttgttgcaaatacgctatctgtagcaggtgcagatcatattatcaccatg

SEQ ID NO: 4096 - DNA, 55 bp, Artificial Sequence
  Synthetic polynucleotide
aggtcttcaagcttttcttcaagctgcccaaggtcttttatttgagcttcaattt

SEQ ID NO: 4097 - DNA, 55 bp, Artificial Sequence
  Synthetic polynucleotide
gattggaccaaaggaacgtgttttacccggaggagagactgctggagacatgggg

SEQ ID NO: 4098 - DNA, 55 bp, Artificial Sequence
  Synthetic polynucleotide
gaagatgctgcctgtgcgtcccccaggggcaggggggctgcctcctccacaagtg

SEQ ID NO: 4099 - DNA, 55 bp, Artificial Sequence
  Synthetic polynucleotide
tcaaattagacttaggcaagtaatgcaatatggtagactggggagaactacaaac

SEQ ID NO: 4100 - DNA, 55 bp, Artificial Sequence
  Synthetic polynucleotide
gtggctcaaaggataacatcaaacacgtcccgggaggcggcagtgtgagtacctt

SEQ ID NO: 4101 - DNA, 55 bp, Artificial Sequence
  Synthetic polynucleotide
acgcgcggactgcgactgcagaagatgacctgggagggctcgcgcgagttcaccg

SEQ ID NO: 4102 - DNA, 55 bp, Artificial Sequence
  Synthetic polynucleotide
aaactcatcctgagtacgcataagcgacgaaggtcatcaacaccaattccagcag

SEQ ID NO: 4103 - DNA, 55 bp, Artificial Sequence
  Synthetic polynucleotide
cccaagggctacaaggcgagcgtgggctgctgggaggggggagttctgcccccac

SEQ ID NO: 4104 - DNA, 55 bp, Artificial Sequence
  Synthetic polynucleotide
tgctcattggctgtgagcgtgcccaggggcgggcggcggggagagcccacggtgg

SEQ ID NO: 4105 - DNA, 55 bp, Artificial Sequence
  Synthetic polynucleotide
ccagacctgggccagacactttgtgaagtaagggatcagcaaggatgtgggatca

SEQ ID NO: 4106 - DNA, 55 bp, Artificial Sequence
  Synthetic polynucleotide
caagccagccatatagacgcctctgctcccaggagagcttcactgaaggacttca

SEQ ID NO: 4107 - DNA, 55 bp, Artificial Sequence
  Synthetic polynucleotide
tgtcttacagacttttacagtattgaataaagggaaggccatcttccggttcagt

SEQ ID NO: 4108 - DNA, 55 bp, Artificial Sequence
  Synthetic polynucleotide
gctttcacacacatacatccctctggacattggctgcaagtggggtaaaagaaag

SEQ ID NO: 4109 - DNA, 55 bp, Artificial Sequence; identical to SEQ ID NO: 4108
  Synthetic polynucleotide

SEQ ID NO: 4110 - DNA, 55 bp, Artificial Sequence
  Synthetic polynucleotide
cctgaaatgactgatacagttttcagggcccggaggactcggaaggtgcgtaagg

SEQ ID NO: 4111 - DNA, 55 bp, Artificial Sequence
  Synthetic polynucleotide
gcggaaacgctctttactgtttaagccaacaggctttggttctttagaaggactt

SEQ ID NO: 4112 - DNA, 55 bp, Artificial Sequence
  Synthetic polynucleotide
aagagaagatacttacagcttcttgtctccaggtctgtaggtttttctttaaatt

SEQ ID NO: 4113 - DNA, 55 bp, Artificial Sequence
  Synthetic polynucleotide
agagttgtgctgatggcagttaatgagctcagggatggtgctgaaaaggtgcttc

SEQ ID NO: 4114 - DNA, 55 bp, Artificial Sequence
  Synthetic polynucleotide
aacaaaagacaaatgcttcctgtacacctgtggcagtcaggaattccagagtgta

SEQ ID NO: 4115 - DNA, 55 bp, Artificial Sequence
  Synthetic polynucleotide
atcttattgtgctgatcttcagcctccttttggggatggaacttcaacgcttctt

SEQ ID NO: 4116 - DNA, 55 bp, Artificial Sequence
  Synthetic polynucleotide
tcccggccctgtggttcggcatcatagtgctgggtcaggaagtgtgtgtacctgg

SEQ ID NO: 4117 - DNA, 20 bp, Artificial Sequence
  Synthetic polynucleotide
gtcgccgaccgcggcggcgg

SEQ ID NO: 4118 - DNA, 20 bp, Artificial Sequence
  Synthetic polynucleotide
gcgtagtactgaggaggagg

SEQ ID NO: 4119 - DNA, 20 bp, Artificial Sequence
  Synthetic polynucleotide
tgcctactcgggggcggggc

SEQ ID NO: 4120 - DNA, 20 bp, Artificial Sequence
  Synthetic polynucleotide
tgagtccccgcggcgcggcg

SEQ ID NO: 4121 - DNA, 20 bp, Artificial Sequence
  Synthetic polynucleotide
cgcgcgcgcgcgcgcgcgcg

SEQ ID NO: 4122 - DNA, 20 bp, Artificial Sequence
  Synthetic polynucleotide
agcagcagcagcagcagcag

SEQ ID NO: 4123 - DNA, 20 bp, Artificial Sequence
  Synthetic polynucleotide
aagaagaagaagaagaagaa

SEQ ID NO: 4124 - DNA, 20 bp, Artificial Sequence
  Synthetic polynucleotide
agcgagcgagcgagcgagcg

SEQ ID NO: 4125 - DNA, 20 bp, Artificial Sequence
  Synthetic polynucleotide
gctaatttcgcgcgcgcgcg

SEQ ID NO: 4126 - DNA, 20 bp, Artificial Sequence
  Synthetic polynucleotide
tttcctttcagcagcagcag

SEQ ID NO: 4127 - DNA, 20 bp, Artificial Sequence
  Synthetic polynucleotide
ggacctttgaagaagaagaa

SEQ ID NO: 4128 - DNA, 20 bp, Artificial Sequence
  Synthetic polynucleotide
tagtttttcggcggcggcgg

SEQ ID NO: 4129 - DNA, 20 bp, Artificial Sequence
  Synthetic polynucleotide
tcgattttaggaggaggagg

SEQ ID NO: 4130 - DNA, 20 bp, Artificial Sequence
  Synthetic polynucleotide
atacttttagcgagcgagcg

SEQ ID NO: 4131 - DNA, 20 bp, Artificial Sequence
  Synthetic polynucleotide
cgcgttttttggggcggggc

SEQ ID NO: 4132 - DNA, 20 bp, Artificial Sequence
  Synthetic polynucleotide
atcaatttttcgcggcgcgg

SEQ ID NO: 4133 - DNA, 20 bp, Artificial Sequence
  Synthetic polynucleotide
cacagcgctggtgtggcgtg

SEQ ID NO: 4134 - DNA, 20 bp, Artificial Sequence
  Synthetic polynucleotide
atgccgttgcgacggcccga

SEQ ID NO: 4135 - DNA, 20 bp, Artificial Sequence
  Synthetic polynucleotide
ggattccagatggggttgat

SEQ ID NO: 4136 - DNA, 20 bp, Artificial Sequence
  Synthetic polynucleotide
taacgatatggggggttatg

SEQ ID NO: 4137 - DNA, 20 bp, Artificial Sequence
  Synthetic polynucleotide
cgccattaaggggtacctaa

SEQ ID NO: 4138 - DNA, 20 bp, Artificial Sequence
  Synthetic polynucleotide
ccgcgctgtggacggccctg

SEQ ID NO: 4139 - DNA, 20 bp, Artificial Sequence
  Synthetic polynucleotide
gcctggttggggtgtacggt

SEQ ID NO: 4140 - DNA, 20 bp, Artificial Sequence
  Synthetic polynucleotide
gattacggggcaatgagtac

SEQ ID NO: 4141 - DNA, 20 bp, Artificial Sequence
  Synthetic polynucleotide
agtgcaggttacattcgtgc

SEQ ID NO: 4142 - DNA, 20 bp, Artificial Sequence
  Synthetic polynucleotide
ttgtgggccagaccttttgt

SEQ ID NO: 4143 - DNA, 20 bp, Artificial Sequence
  Synthetic polynucleotide
tgacggctcatcctgtatga

SEQ ID NO: 4144 - DNA, 20 bp, Artificial Sequence
  Synthetic polynucleotide
ctcggctatatacggagtct

SEQ ID NO: 4145 - DNA, 20 bp, Artificial Sequence
  Synthetic polynucleotide
cgggaagcccgacataccac

SEQ ID NO: 4146 - DNA, 20 bp, Artificial Sequence
  Synthetic polynucleotide
tggacgttttttgcgggcac

SEQ ID NO: 4147 - DNA, 20 bp, Artificial Sequence
  Synthetic polynucleotide
gggcagaatcggtatgacag

SEQ ID NO: 4148 - DNA, 20 bp, Artificial Sequence
  Synthetic polynucleotide
gtcttcaaccaaagagtaca

SEQ ID NO: 4149 - DNA, 20 bp, Artificial Sequence
  Synthetic polynucleotide
aaggcagtatgatacgctgc

SEQ ID NO: 4150 - DNA, 20 bp, Artificial Sequence
  Synthetic polynucleotide
aacccatcctggcctgaaat

SEQ ID NO: 4151 - DNA, 20 bp, Artificial Sequence
  Synthetic polynucleotide
ttcaaacgagttttttttga

SEQ ID NO: 4152 - DNA, 20 bp, Artificial Sequence
  Synthetic polynucleotide
cctatatgtggagaggcgag

SEQ ID NO: 4153 - DNA, 20 bp, Artificial Sequence
  Synthetic polynucleotide
taacggacacgttggggcgt

SEQ ID NO: 4154 - DNA, 20 bp, Artificial Sequence
  Synthetic polynucleotide
cagttccttatcgggactat

SEQ ID NO: 4155 - DNA, 20 bp, Artificial Sequence
  Synthetic polynucleotide
acccaggcctcggttggcct

SEQ ID NO: 4156 - DNA, 20 bp, Artificial Sequence
  Synthetic polynucleotide
acagtcagaaggaagtaaga

SEQ ID NO: 4157 - DNA, 20 bp, Artificial Sequence
  Synthetic polynucleotide
tatgaataaggcgacttata

SEQ ID NO: 4158 - DNA, 20 bp, Artificial Sequence
  Synthetic polynucleotide
ggaagtgtgggctcaaagtg

SEQ ID NO: 4159 - DNA, 20 bp, Artificial Sequence
  Synthetic polynucleotide
cacgcgcgggccgtccggcg

SEQ ID NO: 4160 - DNA, 20 bp, Artificial Sequence
  Synthetic polynucleotide
acttgtggcgtagtgatttg

SEQ ID NO: 4161 - DNA, 20 bp, Artificial Sequence
  Synthetic polynucleotide
cttgtggagagttaggcttg

SEQ ID NO: 4162 - DNA, 20 bp, Artificial Sequence
  Synthetic polynucleotide
ttcgggtactatggcggttc

SEQ ID NO: 4163 - DNA, 20 bp, Artificial Sequence
  Synthetic polynucleotide
ccgggggctagggctatccc

SEQ ID NO: 4164 - DNA, 20 bp, Artificial Sequence
  Synthetic polynucleotide
taggatcgtgcacgcgaggt

SEQ ID NO: 4165 - DNA, 20 bp, Artificial Sequence
  Synthetic polynucleotide
gggtatctttagtacctcgt

SEQ ID NO: 4166 - DNA, 20 bp, Artificial Sequence
  Synthetic polynucleotide
ggccagaaaactccgggaac

SEQ ID NO: 4167 - DNA, 20 bp, Artificial Sequence
  Synthetic polynucleotide
gagtaaatggactcctgcgc

SEQ ID NO: 4168 - DNA, 20 bp, Artificial Sequence
  Synthetic polynucleotide
attcgcacagtggtattgaa

SEQ ID NO: 4169 - DNA, 20 bp, Artificial Sequence
  Synthetic polynucleotide
ctcggttagtgtaaaactac

SEQ ID NO: 4170 - DNA, 20 bp, Artificial Sequence
  Synthetic polynucleotide
aaactgaaccagccccgagt

SEQ ID NO: 4171 - DNA, 20 bp, Artificial Sequence
  Synthetic polynucleotide
ggaacgtgcctaagggttaa

SEQ ID NO: 4172 - DNA, 20 bp, Artificial Sequence
  Synthetic polynucleotide
cttagccggtgcgggcctgc

SEQ ID NO: 4173 - DNA, 20 bp, Artificial Sequence
  Synthetic polynucleotide
taagatgaactaggagaact

SEQ ID NO: 4174 - DNA, 20 bp, Artificial Sequence
  Synthetic polynucleotide
cgggcttttgagggcgtttg

SEQ ID NO: 4175 - DNA, 20 bp, Artificial Sequence
  Synthetic polynucleotide
cgctttccatgggacggcca

SEQ ID NO: 4176 - DNA, 20 bp, Artificial Sequence
  Synthetic polynucleotide
ccaacctcagggctgacctc

SEQ ID NO: 4177 - DNA, 20 bp, Artificial Sequence
  Synthetic polynucleotide
tttcttaaggcgtgccttta

SEQ ID NO: 4178 - DNA, 20 bp, Artificial Sequence
  Synthetic polynucleotide
ccctcaaggtatcggtatca

SEQ ID NO: 4179 - DNA, 20 bp, Artificial Sequence
  Synthetic polynucleotide
tagccggggtcctagacgcc

SEQ ID NO: 4180 - DNA, 20 bp, Artificial Sequence
  Synthetic polynucleotide
tctctggaacgaagcctctc

SEQ ID NO: 4181 - DNA, 20 bp, Artificial Sequence
  Synthetic polynucleotide
tccgggctagcctcagatcc

SEQ ID NO: 4182 - DNA, 20 bp, Artificial Sequence
  Synthetic polynucleotide
tctgggactttattgagctc

SEQ ID NO: 4183 - DNA, 20 bp, Artificial Sequence
  Synthetic polynucleotide
ggggagtcgtttagcgcgtg

SEQ ID NO: 4184 - DNA, 20 bp, Artificial Sequence
  Synthetic polynucleotide
aggcgtgccagatagcccgg

SEQ ID NO: 4185 - DNA, 20 bp, Artificial Sequence
  Synthetic polynucleotide
gggcgttctgaaatggaaga

SEQ ID NO: 4186 - DNA, 20 bp, Artificial Sequence
  Synthetic polynucleotide
gaaatacgggcaagcgcgta

SEQ ID NO: 4187 - DNA, 20 bp, Artificial Sequence
  Synthetic polynucleotide
aggcgttgagtggttgttgt

SEQ ID NO: 4188 - DNA, 20 bp, Artificial Sequence
  Synthetic polynucleotide
tacgtggctgcggaattgac

SEQ ID NO: 4189 - DNA, 20 bp, Artificial Sequence
  Synthetic polynucleotide
gaacttcgcgtcaaaatcaa

SEQ ID NO: 4190 - DNA, 20 bp, Artificial Sequence
  Synthetic polynucleotide
tgacgggataatgtgaaaac

SEQ ID NO: 4191 - DNA, 20 bp, Artificial Sequence
  Synthetic polynucleotide
tgacgggataatgtgccccc

SEQ ID NO: 4192 - DNA, 20 bp, Artificial Sequence
  Synthetic polynucleotide
tgacgggataatgtgggggc

SEQ ID NO: 4193 - DNA, 20 bp, Artificial Sequence
  Synthetic polynucleotide
tgacgggataatgtgttttc

SEQ ID NO: 4194 - DNA, 20 bp, Artificial Sequence
  Synthetic polynucleotide
tgacgggataatgtgacacc

SEQ ID NO: 4195 - DNA, 20 bp, Artificial Sequence
  Synthetic polynucleotide
tgacgggataatgtgagagc

SEQ ID NO: 4196 - DNA, 20 bp, Artificial Sequence
  Synthetic polynucleotide
tgacgggataatgtgatatc

SEQ ID NO: 4197 - DNA, 20 bp, Artificial Sequence
  Synthetic polynucleotide
tgacgggataatgtgcacac

SEQ ID NO: 4198 - DNA, 20 bp, Artificial Sequence
  Synthetic polynucleotide
tgacgggataatgtgcgcgc

SEQ ID NO: 4199 - DNA, 20 bp, Artificial Sequence
  Synthetic polynucleotide
tgacgggataatgtgctctc

SEQ ID NO: 4200 - DNA, 20 bp, Artificial Sequence
  Synthetic polynucleotide
tgacgggataatgtggagac

SEQ ID NO: 4201 - DNA, 20 bp, Artificial Sequence
  Synthetic polynucleotide
tgacgggataatgtggcgcc

SEQ ID NO: 4202 - DNA, 20 bp, Artificial Sequence
  Synthetic polynucleotide
tgacgggataatgtggtgtc

SEQ ID NO: 4203 - DNA, 20 bp, Artificial Sequence
  Synthetic polynucleotide
tgacgggataatgtgtatac

SEQ ID NO: 4204 - DNA, 20 bp, Artificial Sequence
  Synthetic polynucleotide
tgacgggataatgtgtctcc

SEQ ID NO: 4205 - DNA, 20 bp, Artificial Sequence
  Synthetic polynucleotide
tgacgggataatgtgtgtgc

SEQ ID NO: 4206 - DNA, 20 bp, Artificial Sequence
  Synthetic polynucleotide
tgacgggataatgtgatagc

SEQ ID NO: 4207 - DNA, 20 bp, Artificial Sequence
  Synthetic polynucleotide
tgacgggataatgtgacatc

SEQ ID NO: 4208 - DNA, 20 bp, Artificial Sequence
  Synthetic polynucleotide
tgacgggataatgtgagatc

SEQ ID NO: 4209 - DNA, 20 bp, Artificial Sequence
  Synthetic polynucleotide
tgacgggataatgtgagacc

SEQ ID NO: 4210 - DNA, 20 bp, Artificial Sequence
  Synthetic polynucleotide
tgacgggataatgtgatacc

SEQ ID NO: 4211 - DNA, 20 bp, Artificial Sequence
  Synthetic polynucleotide
tgacgggataatgtgcgctc

SEQ ID NO: 4212 - DNA, 20 bp, Artificial Sequence
  Synthetic polynucleotide
tgacgggataatgtgcacgc

SEQ ID NO: 4213 - DNA, 20 bp, Artificial Sequence
  Synthetic polynucleotide
tgacgggataatgtgctcgc

SEQ ID NO: 4214 - DNA, 20 bp, Artificial Sequence
  Synthetic polynucleotide
tgacgggataatgtgctcac

SEQ ID NO: 4215 - DNA, 20 bp, Artificial Sequence
  Synthetic polynucleotide
tgacgggataatgtgcactc

SEQ ID NO: 4216 - DNA, 20 bp, Artificial Sequence
  Synthetic polynucleotide
tgacgggataatgtggcgtc

SEQ ID NO: 4217 - DNA, 20 bp, Artificial Sequence
  Synthetic polynucleotide
tgacgggataatgtggagcc

SEQ ID NO: 4218 - DNA, 20 bp, Artificial Sequence
  Synthetic polynucleotide
tgacgggataatgtggtgcc

SEQ ID NO: 4219 - DNA, 20 bp, Artificial Sequence
  Synthetic polynucleotide
tgacgggataatgtggagtc

SEQ ID NO: 4220 - DNA, 20 bp, Artificial Sequence
  Synthetic polynucleotide
tgacgggataatgtggtgac

SEQ ID NO: 4221 - DNA, 20 bp, Artificial Sequence
  Synthetic polynucleotide
tgacgggataatgtgtatcc

SEQ ID NO: 4222 - DNA, 20 bp, Artificial Sequence
  Synthetic polynucleotide
tgacgggataatgtgtctac

SEQ ID NO: 4223 - DNA, 20 bp, Artificial Sequence
  Synthetic polynucleotide
tgacgggataatgtgtgtcc

SEQ ID NO: 4224 - DNA, 20 bp, Artificial Sequence
  Synthetic polynucleotide
tgacgggataatgtgtgtac

SEQ ID NO: 4225 - DNA, 20 bp, Artificial Sequence
  Synthetic polynucleotide
tgacgggataatgtgtatgc

SEQ ID NO: 4226 - DNA, 20 bp, Artificial Sequence
  Synthetic polynucleotide
tgacgggataatgtgtagac

SEQ ID NO: 4227 - DNA, 20 bp, Artificial Sequence
  Synthetic polynucleotide
tgacgggataatgtgtacac

SEQ ID NO: 4228 - DNA, 20 bp, Artificial Sequence
  Synthetic polynucleotide
tgacgggataatgtggacac

SEQ ID NO: 4229 - DNA, 20 bp, Artificial Sequence
  Synthetic polynucleotide
tgacgggataatgtgcagac

SEQ ID NO: 4230 - DNA, 20 bp, Artificial Sequence
  Synthetic polynucleotide
tgacgggataatgtggatac

SEQ ID NO: 4231 - DNA, 20 bp, Artificial Sequence
  Synthetic polynucleotide
tgacgggataatgtgacgcc

SEQ ID NO: 4232 - DNA, 20 bp, Artificial Sequence
  Synthetic polynucleotide
tgacgggataatgtgtcacc

SEQ ID NO: 4233 - DNA, 20 bp, Artificial Sequence
  Synthetic polynucleotide
tgacgggataatgtggcacc

SEQ ID NO: 4234 - DNA, 20 bp, Artificial Sequence
  Synthetic polynucleotide
tgacgggataatgtggctcc

SEQ ID NO: 4235 - DNA, 20 bp, Artificial Sequence
  Synthetic polynucleotide
tgacgggataatgtgtcgcc

SEQ ID NO: 4236 - DNA, 20 bp, Artificial Sequence
  Synthetic polynucleotide
tgacgggataatgtgcgagc

SEQ ID NO: 4237 - DNA, 20 bp, Artificial Sequence
  Synthetic polynucleotide
tgacgggataatgtgagcgc

SEQ ID NO: 4238 - DNA, 20 bp, Artificial Sequence
  Synthetic polynucleotide
tgacgggataatgtgagtgc

SEQ ID NO: 4239 - DNA, 20 bp, Artificial Sequence
  Synthetic polynucleotide
tgacgggataatgtgtgagc

SEQ ID NO: 4240 - DNA, 20 bp, Artificial Sequence
  Synthetic polynucleotide
tgacgggataatgtgtgcgc

SEQ ID NO: 4241 - DNA, 20 bp, Artificial Sequence
  Synthetic polynucleotide
tgacgggataatgtggtctc

SEQ ID NO: 4242 - DNA, 20 bp, Artificial Sequence
  Synthetic polynucleotide
tgacgggataatgtgctatc

SEQ ID NO: 4243 - DNA, 20 bp, Artificial Sequence
  Synthetic polynucleotide
tgacgggataatgtgatgtc

SEQ ID NO: 4244 - DNA, 20 bp, Artificial Sequence
  Synthetic polynucleotide
tgacgggataatgtgctgtc

SEQ ID NO: 4245 - DNA, 20 bp, Artificial Sequence
  Synthetic polynucleotide
tgacgggataatgtgatctc

SEQ ID NO: 4246 - DNA, 20 bp, Artificial Sequence
  Synthetic polynucleotide
tgacgggataatgtgacgtc

SEQ ID NO: 4247 - DNA, 20 bp, Artificial Sequence
  Synthetic polynucleotide
tgacgggataatgtgactac

SEQ ID NO: 4248 - DNA, 20 bp, Artificial Sequence
  Synthetic polynucleotide
tgacgggataatgtgagtac

SEQ ID NO: 4249 - DNA, 20 bp, Artificial Sequence
  Synthetic polynucleotide
tgacgggataatgtgactgc

SEQ ID NO: 4250 - DNA, 20 bp, Artificial Sequence
  Synthetic polynucleotide
tgacgggataatgtgatcgc

SEQ ID NO: 4251 - DNA, 20 bp, Artificial Sequence
  Synthetic polynucleotide
tgacgggataatgtgctgac

SEQ ID NO: 4252 - DNA, 20 bp, Artificial Sequence
  Synthetic polynucleotide
tgacgggataatgtgcgtac

SEQ ID NO: 4253 - DNA, 20 bp, Artificial Sequence
  Synthetic polynucleotide
tgacgggataatgtgcatgc

SEQ ID NO: 4254 - DNA, 20 bp, Artificial Sequence
  Synthetic polynucleotide
tgacgggataatgtgctacc

SEQ ID NO: 4255 - DNA, 20 bp, Artificial Sequence
  Synthetic polynucleotide
tgacgggataatgtgcgacc

SEQ ID NO: 4256 - DNA, 20 bp, Artificial Sequence
  Synthetic polynucleotide
tgacgggataatgtggtacc

SEQ ID NO: 4257 - DNA, 20 bp, Artificial Sequence
  Synthetic polynucleotide
tgacgggataatgtggatgc

SEQ ID NO: 4258 - DNA, 20 bp, Artificial Sequence
  Synthetic polynucleotide
tgacgggataatgtggactc

SEQ ID NO: 4259 - DNA, 20 bp, Artificial Sequence
  Synthetic polynucleotide
tgacgggataatgtggctac

SEQ ID NO: 4260 - DNA, 20 bp, Artificial Sequence
  Synthetic polynucleotide
tgacgggataatgtggtcgc

SEQ ID NO: 4261 - DNA, 20 bp, Artificial Sequence
  Synthetic polynucleotide
tgacgggataatgtgtagcc

SEQ ID NO: 4262 - DNA, 20 bp, Artificial Sequence
  Synthetic polynucleotide
tgacgggataatgtgtgacc

SEQ ID NO: 4263 - DNA, 20 bp, Artificial Sequence
  Synthetic polynucleotide
tgacgggataatgtgtgcac

SEQ ID NO: 4264 - DNA, 20 bp, Artificial Sequence
  Synthetic polynucleotide
tgacgggataatgtgtcgtc

SEQ ID NO: 4265 - DNA, 20 bp, Artificial Sequence
  Synthetic polynucleotide
tgacgggataatgtgtcgac

SEQ ID NO: 4266 - DNA, 20 bp, Artificial Sequence
  Synthetic polynucleotide
cgcgaaccgaaatcgaaaac

SEQ ID NO: 4267 - DNA, 20 bp, Artificial Sequence
  Synthetic polynucleotide
cgcgaaccgaaatcgccccc

SEQ ID NO: 4268 - DNA, 20 bp, Artificial Sequence
  Synthetic polynucleotide
cgcgaaccgaaatcgggggc

SEQ ID NO: 4269 - DNA, 20 bp, Artificial Sequence
  Synthetic polynucleotide
cgcgaaccgaaatcgttttc

SEQ ID NO: 4270 - DNA, 20 bp, Artificial Sequence
  Synthetic polynucleotide
cgcgaaccgaaatcgacacc

SEQ ID NO: 4271 - DNA, 20 bp, Artificial Sequence
  Synthetic polynucleotide
cgcgaaccgaaatcgagagc

SEQ ID NO: 4272 - DNA, 20 bp, Artificial Sequence
  Synthetic polynucleotide
cgcgaaccgaaatcgatatc

SEQ ID NO: 4273 - DNA, 20 bp, Artificial Sequence
  Synthetic polynucleotide
cgcgaaccgaaatcgcacac

SEQ ID NO: 4274 - DNA, 20 bp, Artificial Sequence
  Synthetic polynucleotide
cgcgaaccgaaatcgcgcgc

SEQ ID NO: 4275 - DNA, 20 bp, Artificial Sequence
  Synthetic polynucleotide
cgcgaaccgaaatcgctctc

SEQ ID NO: 4276 - DNA, 20 bp, Artificial Sequence
  Synthetic polynucleotide
cgcgaaccgaaatcggagac

SEQ ID NO: 4277 - DNA, 20 bp, Artificial Sequence
  Synthetic polynucleotide
cgcgaaccgaaatcggcgcc

SEQ ID NO: 4278 - DNA, 20 bp, Artificial Sequence
  Synthetic polynucleotide
cgcgaaccgaaatcggtgtc

SEQ ID NO: 4279 - DNA, 20 bp, Artificial Sequence
  Synthetic polynucleotide
cgcgaaccgaaatcgtatac

SEQ ID NO: 4280 - DNA, 20 bp, Artificial Sequence
  Synthetic polynucleotide
cgcgaaccgaaatcgtctcc

SEQ ID NO: 4281 - DNA, 20 bp, Artificial Sequence
  Synthetic polynucleotide
cgcgaaccgaaatcgtgtgc

SEQ ID NO: 4282 - DNA, 20 bp, Artificial Sequence
  Synthetic polynucleotide
cgcgaaccgaaatcgacatc

SEQ ID NO: 4283 - DNA, 20 bp, Artificial Sequence
  Synthetic polynucleotide
cgcgaaccgaaatcgatagc

SEQ ID NO: 4284 - DNA, 20 bp, Artificial Sequence
  Synthetic polynucleotide
cgcgaaccgaaatcgacagc

SEQ ID NO: 4285 - DNA, 20 bp, Artificial Sequence
  Synthetic polynucleotide
cgcgaaccgaaatcgatacc

SEQ ID NO: 4286 - DNA, 20 bp, Artificial Sequence
  Synthetic polynucleotide
cgcgaaccgaaatcgagatc

SEQ ID NO: 4287 - DNA, 20 bp, Artificial Sequence
  Synthetic polynucleotide
cgcgaaccgaaatcgcgctc

SEQ ID NO: 4288 - DNA, 20 bp, Artificial Sequence
  Synthetic polynucleotide
cgcgaaccgaaatcgcacgc

SEQ ID NO: 4289 - DNA, 20 bp, Artificial Sequence
  Synthetic polynucleotide
cgcgaaccgaaatcgctcac

SEQ ID NO: 4290 - DNA, 20 bp, Artificial Sequence
  Synthetic polynucleotide
cgcgaaccgaaatcgcactc

SEQ ID NO: 4291 - DNA, 20 bp, Artificial Sequence
  Synthetic polynucleotide
cgcgaaccgaaatcgcgcac

SEQ ID NO: 4292 - DNA, 20 bp, Artificial Sequence
  Synthetic polynucleotide
cgcgaaccgaaatcggtgcc

SEQ ID NO: 4293 - DNA, 20 bp, Artificial Sequence
  Synthetic polynucleotide
cgcgaaccgaaatcggtgac

SEQ ID NO: 4294 - DNA, 20 bp, Artificial Sequence
  Synthetic polynucleotide
cgcgaaccgaaatcggcgac

SEQ ID NO: 4295 - DNA, 20 bp, Artificial Sequence
  Synthetic polynucleotide
cgcgaaccgaaatcggcgtc

SEQ ID NO: 4296 - DNA, 20 bp, Artificial Sequence
  Synthetic polynucleotide
cgcgaaccgaaatcggagcc

SEQ ID NO: 4297 - DNA, 20 bp, Artificial Sequence
  Synthetic polynucleotide
cgcgaaccgaaatcgtgtac

SEQ ID NO: 4298 - DNA, 20 bp, Artificial Sequence
  Synthetic polynucleotide
cgcgaaccgaaatcgtatgc

SEQ ID NO: 4299 - DNA, 20 bp, Artificial Sequence
  Synthetic polynucleotide
cgcgaaccgaaatcgtatcc

SEQ ID NO: 4300 - DNA, 20 bp, Artificial Sequence
  Synthetic polynucleotide
cgcgaaccgaaatcgtctac

SEQ ID NO: 4301 - DNA, 20 bp, Artificial Sequence
  Synthetic polynucleotide
cgcgaaccgaaatcgtgtcc

SEQ ID NO: 4302 - DNA, 20 bp, Artificial Sequence
  Synthetic polynucleotide
cgcgaaccgaaatcgtagac

SEQ ID NO: 4303 - DNA, 20 bp, Artificial Sequence
  Synthetic polynucleotide
cgcgaaccgaaatcggatac

SEQ ID NO: 4304 - DNA, 20 bp, Artificial Sequence
  Synthetic polynucleotide
cgcgaaccgaaatcgcagac

SEQ ID NO: 4305 - DNA, 20 bp, Artificial Sequence
  Synthetic polynucleotide
cgcgaaccgaaatcggacac

SEQ ID NO: 4306 - DNA, 20 bp, Artificial Sequence
  Synthetic polynucleotide
cgcgaaccgaaatcgtacac

SEQ ID NO: 4307 - DNA, 20 bp, Artificial Sequence
  Synthetic polynucleotide
cgcgaaccgaaatcggcacc

SEQ ID NO: 4308 - DNA, 20 bp, Artificial Sequence
  Synthetic polynucleotide
cgcgaaccgaaatcgtcacc

SEQ ID NO: 4309 - DNA, 20 bp, Artificial Sequence
  Synthetic polynucleotide
cgcgaaccgaaatcgactcc

SEQ ID NO: 4310 - DNA, 20 bp, Artificial Sequence
  Synthetic polynucleotide
cgcgaaccgaaatcggctcc

SEQ ID NO: 4311 - DNA, 20 bp, Artificial Sequence
  Synthetic polynucleotide
cgcgaaccgaaatcgtcgcc

SEQ ID NO: 4312 - DNA, 20 bp, Artificial Sequence
  Synthetic polynucleotide
cgcgaaccgaaatcgtgagc

SEQ ID NO: 4313 - DNA, 20 bp, Artificial Sequence
  Synthetic polynucleotide
cgcgaaccgaaatcgagtgc

SEQ ID NO: 4314 - DNA, 20 bp, Artificial Sequence
  Synthetic polynucleotide
cgcgaaccgaaatcgtgcgc

SEQ ID NO: 4315 - DNA, 20 bp, Artificial Sequence
  Synthetic polynucleotide
cgcgaaccgaaatcgagcgc

SEQ ID NO: 4316 - DNA, 20 bp, Artificial Sequence
  Synthetic polynucleotide
cgcgaaccgaaatcgcgtgc

SEQ ID NO: 4317 - DNA, 20 bp, Artificial Sequence
  Synthetic polynucleotide
cgcgaaccgaaatcgctgtc

SEQ ID NO: 4318 - DNA, 20 bp, Artificial Sequence
  Synthetic polynucleotide
cgcgaaccgaaatcggtatc

SEQ ID NO: 4319 - DNA, 20 bp, Artificial Sequence
  Synthetic polynucleotide
cgcgaaccgaaatcgatctc

SEQ ID NO: 4320 - DNA, 20 bp, Artificial Sequence
  Synthetic polynucleotide
cgcgaaccgaaatcggtctc

SEQ ID NO: 4321 - DNA, 20 bp, Artificial Sequence
  Synthetic polynucleotide
cgcgaaccgaaatcgatgtc

SEQ ID NO: 4322 - DNA, 20 bp, Artificial Sequence
  Synthetic polynucleotide
cgcgaaccgaaatcgagtcc

SEQ ID NO: 4323 - DNA, 20 bp, Artificial Sequence
  Synthetic polynucleotide
cgcgaaccgaaatcgatgcc

SEQ ID NO: 4324 - DNA, 20 bp, Artificial Sequence
  Synthetic polynucleotide
cgcgaaccgaaatcgatcgc

SEQ ID NO: 4325 - DNA, 20 bp, Artificial Sequence
  Synthetic polynucleotide
cgcgaaccgaaatcgagtac

SEQ ID NO: 4326 - DNA, 20 bp, Artificial Sequence
  Synthetic polynucleotide
cgcgaaccgaaatcgactac

SEQ ID NO: 4327 - DNA, 20 bp, Artificial Sequence
  Synthetic polynucleotide
cgcgaaccgaaatcgcatcc

SEQ ID NO: 4328 - DNA, 20 bp, Artificial Sequence
  Synthetic polynucleotide
cgcgaaccgaaatcgctagc

SEQ ID NO: 4329 - DNA, 20 bp, Artificial Sequence
  Synthetic polynucleotide
cgcgaaccgaaatcgcgatc

SEQ ID NO: 4330 - DNA, 20 bp, Artificial Sequence
  Synthetic polynucleotide
cgcgaaccgaaatcgcgtcc

SEQ ID NO: 4331 - DNA, 20 bp, Artificial Sequence
  Synthetic polynucleotide
cgcgaaccgaaatcgctacc

SEQ ID NO: 4332 - DNA, 20 bp, Artificial Sequence
  Synthetic polynucleotide
cgcgaaccgaaatcggactc

SEQ ID NO: 4333 - DNA, 20 bp, Artificial Sequence
  Synthetic polynucleotide
cgcgaaccgaaatcggatcc

SEQ ID NO: 4334 - DNA, 20 bp, Artificial Sequence
  Synthetic polynucleotide
cgcgaaccgaaatcggatgc

SEQ ID NO: 4335 - DNA, 20 bp, Artificial Sequence
  Synthetic polynucleotide
cgcgaaccgaaatcggtagc

SEQ ID NO: 4336 - DNA, 20 bp, Artificial Sequence
  Synthetic polynucleotide
cgcgaaccgaaatcggcatc

SEQ ID NO: 4337 - DNA, 20 bp, Artificial Sequence
  Synthetic polynucleotide
cgcgaaccgaaatcgtacgc

SEQ ID NO: 4338 - DNA, 20 bp, Artificial Sequence
  Synthetic polynucleotide
cgcgaaccgaaatcgtgctc

SEQ ID NO: 4339 - DNA, 20 bp, Artificial Sequence
  Synthetic polynucleotide
cgcgaaccgaaatcgtgcac

SEQ ID NO: 4340 - DNA, 20 bp, Artificial Sequence
  Synthetic polynucleotide
cgcgaaccgaaatcgtcgtc

SEQ ID NO: 4341 - DNA, 20 bp, Artificial Sequence
  Synthetic polynucleotide
cgcgaaccgaaatcgtagcc

SEQ ID NO: 4342 - DNA, 20 bp, Artificial Sequence
  Synthetic polynucleotide
agcggaccagccagcaaaat

SEQ ID NO: 4343 - DNA, 20 bp, Artificial Sequence
  Synthetic polynucleotide
agcggaccagccagccccct

SEQ ID NO: 4344 - DNA, 20 bp, Artificial Sequence
  Synthetic polynucleotide
agcggaccagccagcggggt

SEQ ID NO: 4345 - DNA, 20 bp, Artificial Sequence
  Synthetic polynucleotide
agcggaccagccagcttttt

SEQ ID NO: 4346 - DNA, 20 bp, Artificial Sequence
  Synthetic polynucleotide
agcggaccagccagcacact

SEQ ID NO: 4347 - DNA, 20 bp, Artificial Sequence
  Synthetic polynucleotide
agcggaccagccagcagagt

SEQ ID NO: 4348 - DNA, 20 bp, Artificial Sequence
  Synthetic polynucleotide
agcggaccagccagcatatt

SEQ ID NO: 4349 - DNA, 20 bp, Artificial Sequence
  Synthetic polynucleotide
agcggaccagccagccacat

SEQ ID NO: 4350 - DNA, 20 bp, Artificial Sequence
  Synthetic polynucleotide
agcggaccagccagccgcgt

SEQ ID NO: 4351 - DNA, 20 bp, Artificial Sequence
  Synthetic polynucleotide
agcggaccagccagcctctt

SEQ ID NO: 4352 - DNA, 20 bp, Artificial Sequence
  Synthetic polynucleotide
agcggaccagccagcgagat

SEQ ID NO: 4353 - DNA, 20 bp, Artificial Sequence
  Synthetic polynucleotide
agcggaccagccagcgcgct

SEQ ID NO: 4354 - DNA, 20 bp, Artificial Sequence
  Synthetic polynucleotide
agcggaccagccagcgtgtt

SEQ ID NO: 4355 - DNA, 20 bp, Artificial Sequence
  Synthetic polynucleotide
agcggaccagccagctatat

SEQ ID NO: 4356 - DNA, 20 bp, Artificial Sequence
  Synthetic polynucleotide
agcggaccagccagctctct

SEQ ID NO: 4357 - DNA, 20 bp, Artificial Sequence
  Synthetic polynucleotide
agcggaccagccagctgtgt

SEQ ID NO: 4358 - DNA, 20 bp, Artificial Sequence
  Synthetic polynucleotide
agcggaccagccagcagact

SEQ ID NO: 4359 - DNA, 20 bp, Artificial Sequence
  Synthetic polynucleotide
agcggaccagccagcatagt

SEQ ID NO: 4360 - DNA, 20 bp, Artificial Sequence
  Synthetic polynucleotide
agcggaccagccagcacagt

SEQ ID NO: 4361 - DNA, 20 bp, Artificial Sequence
  Synthetic polynucleotide
agcggaccagccagcagatt

SEQ ID NO: 4362 - DNA, 20 bp, Artificial Sequence
  Synthetic polynucleotide
agcggaccagccagcatact

SEQ ID NO: 4363 - DNA, 20 bp, Artificial Sequence
  Synthetic polynucleotide
agcggaccagccagccgctt

SEQ ID NO: 4364 - DNA, 20 bp, Artificial Sequence
  Synthetic polynucleotide
agcggaccagccagcctcgt

SEQ ID NO: 4365 - DNA, 20 bp, Artificial Sequence
  Synthetic polynucleotide
agcggaccagccagccacgt

SEQ ID NO: 4366 - DNA, 20 bp, Artificial Sequence
  Synthetic polynucleotide
agcggaccagccagccgcat

SEQ ID NO: 4367 - DNA, 20 bp, Artificial Sequence
  Synthetic polynucleotide
agcggaccagccagcctcat

SEQ ID NO: 4368 - DNA, 20 bp, Artificial Sequence
  Synthetic polynucleotide
agcggaccagccagcgagtt

SEQ ID NO: 4369 - DNA, 20 bp, Artificial Sequence
  Synthetic polynucleotide
agcggaccagccagcgagct

SEQ ID NO: 4370 - DNA, 20 bp, Artificial Sequence
  Synthetic polynucleotide
agcggaccagccagcgcgat

SEQ ID NO: 4371 - DNA, 20 bp, Artificial Sequence
  Synthetic polynucleotide
agcggaccagccagcgtgat

SEQ ID NO: 4372 - DNA, 20 bp, Artificial Sequence
  Synthetic polynucleotide
agcggaccagccagcgtgct

SEQ ID NO: 4373 - DNA, 20 bp, Artificial Sequence
  Synthetic polynucleotide
agcggaccagccagctctgt

SEQ ID NO: 4374 - DNA, 20 bp, Artificial Sequence
  Synthetic polynucleotide
agcggaccagccagctatct

SEQ ID NO: 4375 - DNA, 20 bp, Artificial Sequence
  Synthetic polynucleotide
agcggaccagccagctctat

SEQ ID NO: 4376 - DNA, 20 bp, Artificial Sequence
  Synthetic polynucleotide
agcggaccagccagctgtct

SEQ ID NO: 4377 - DNA, 20 bp, Artificial Sequence
  Synthetic polynucleotide
agcggaccagccagctgtat

SEQ ID NO: 4378 - DNA, 20 bp, Artificial Sequence
  Synthetic polynucleotide
agcggaccagccagctacat

SEQ ID NO: 4379 - DNA, 20 bp, Artificial Sequence
  Synthetic polynucleotide
agcggaccagccagcgacat

SEQ ID NO: 4380 - DNA, 20 bp, Artificial Sequence
  Synthetic polynucleotide
agcggaccagccagctagat

SEQ ID NO: 4381 - DNA, 20 bp, Artificial Sequence
  Synthetic polynucleotide
agcggaccagccagccatat

SEQ ID NO: 4382 - DNA, 20 bp, Artificial Sequence
  Synthetic polynucleotide
agcggaccagccagcgatat

SEQ ID NO: 4383 - DNA, 20 bp, Artificial Sequence
  Synthetic polynucleotide
agcggaccagccagcactct

SEQ ID NO: 4384 - DNA, 20 bp, Artificial Sequence
  Synthetic polynucleotide
agcggaccagccagcgcact

SEQ ID NO: 4385 - DNA, 20 bp, Artificial Sequence
  Synthetic polynucleotide
agcggaccagccagctcgct

SEQ ID NO: 4386 - DNA, 20 bp, Artificial Sequence
  Synthetic polynucleotide
agcggaccagccagcacgct

SEQ ID NO: 4387 - DNA, 20 bp, Artificial Sequence
  Synthetic polynucleotide
agcggaccagccagcgctct

SEQ ID NO: 4388 - DNA, 20 bp, Artificial Sequence
  Synthetic polynucleotide
agcggaccagccagcagcgt

SEQ ID NO: 4389 - DNA, 20 bp, Artificial Sequence
  Synthetic polynucleotide
agcggaccagccagccgagt

SEQ ID NO: 4390 - DNA, 20 bp, Artificial Sequence
  Synthetic polynucleotide
agcggaccagccagctgcgt

SEQ ID NO: 4391 - DNA, 20 bp, Artificial Sequence
  Synthetic polynucleotide
agcggaccagccagctgagt

SEQ ID NO: 4392 - DNA, 20 bp, Artificial Sequence
  Synthetic polynucleotide
agcggaccagccagcagtgt

SEQ ID NO: 4393 - DNA, 20 bp, Artificial Sequence
  Synthetic polynucleotide
agcggaccagccagcatgtt

SEQ ID NO: 4394 - DNA, 20 bp, Artificial Sequence
  Synthetic polynucleotide
agcggaccagccagcgtatt

SEQ ID NO: 4395 - DNA, 20 bp, Artificial Sequence
  Synthetic polynucleotide
agcggaccagccagcctatt

SEQ ID NO: 4396 - DNA, 20 bp, Artificial Sequence
  Synthetic polynucleotide
agcggaccagccagcctgtt

SEQ ID NO: 4397 - DNA, 20 bp, Artificial Sequence
  Synthetic polynucleotide
agcggaccagccagcgtctt

SEQ ID NO: 4398 - DNA, 20 bp, Artificial Sequence
  Synthetic polynucleotide
agcggaccagccagcactat

SEQ ID NO: 4399 - DNA, 20 bp, Artificial Sequence
  Synthetic polynucleotide
agcggaccagccagcactgt

SEQ ID NO: 4400 - DNA, 20 bp, Artificial Sequence
  Synthetic polynucleotide
agcggaccagccagcatcat

SEQ ID NO: 4401 - DNA, 20 bp, Artificial Sequence
  Synthetic polynucleotide
agcggaccagccagcagctt

SEQ ID NO: 4402 - DNA, 20 bp, Artificial Sequence
  Synthetic polynucleotide
agcggaccagccagcagtct

SEQ ID NO: 4403 - DNA, 20 bp, Artificial Sequence
  Synthetic polynucleotide
agcggaccagccagccatct

SEQ ID NO: 4404 - DNA, 20 bp, Artificial Sequence
  Synthetic polynucleotide
agcggaccagccagccgact

SEQ ID NO: 4405 - DNA, 20 bp, Artificial Sequence
  Synthetic polynucleotide
agcggaccagccagcctagt

SEQ ID NO: 4406 - DNA, 20 bp, Artificial Sequence
  Synthetic polynucleotide
agcggaccagccagcctgat

SEQ ID NO: 4407 - DNA, 20 bp, Artificial Sequence
  Synthetic polynucleotide
agcggaccagccagccagtt

SEQ ID NO: 4408 - DNA, 20 bp, Artificial Sequence
  Synthetic polynucleotide
agcggaccagccagcgtcgt

SEQ ID NO: 4409 - DNA, 20 bp, Artificial Sequence
  Synthetic polynucleotide
agcggaccagccagcgctgt

SEQ ID NO: 4410 - DNA, 20 bp, Artificial Sequence
  Synthetic polynucleotide
agcggaccagccagcgcatt

SEQ ID NO: 4411 - DNA, 20 bp, Artificial Sequence
  Synthetic polynucleotide
agcggaccagccagcgctat

SEQ ID NO: 4412 - DNA, 20 bp, Artificial Sequence
  Synthetic polynucleotide
agcggaccagccagcgactt

SEQ ID NO: 4413 - DNA, 20 bp, Artificial Sequence
  Synthetic polynucleotide
agcggaccagccagctacgt

SEQ ID NO: 4414 - DNA, 20 bp, Artificial Sequence
  Synthetic polynucleotide
agcggaccagccagctagtt

SEQ ID NO: 4415 - DNA, 20 bp, Artificial Sequence
  Synthetic polynucleotide
agcggaccagccagctcagt

SEQ ID NO: 4416 - DNA, 20 bp, Artificial Sequence
  Synthetic polynucleotide
agcggaccagccagctgact

SEQ ID NO: 4417 - DNA, 20 bp, Artificial Sequence
  Synthetic polynucleotide
agcggaccagccagctagct

SEQ ID NO: 4418 - DNA, 20 bp, Artificial Sequence
  Synthetic polynucleotide
gctgatgtagtcactcttga

SEQ ID NO: 4419 - DNA, 20 bp, Artificial Sequence
  Synthetic polynucleotide
agatgcaggctgcagatgcc

SEQ ID NO: 4420 - DNA, 20 bp, Artificial Sequence
  Synthetic polynucleotide
ggccctcggcggcggctccc

SEQ ID NO: 4421 - DNA, 20 bp, Artificial Sequence
  Synthetic polynucleotide
acagaacatgttgttataga

SEQ ID NO: 4422 - DNA, 20 bp, Artificial Sequence
  Synthetic polynucleotide
acagattctggaaagctcct

SEQ ID NO: 4423 - DNA, 20 bp, Artificial Sequence
  Synthetic polynucleotide
ggtcaacaagtggaactcta

SEQ ID NO: 4424 - DNA, 20 bp, Artificial Sequence
  Synthetic polynucleotide
ggagtatttcaggggctctt

SEQ ID NO: 4425 - DNA, 20 bp, Artificial Sequence
  Synthetic polynucleotide
gggagggctgtgctgctagt

SEQ ID NO: 4426 - DNA, 20 bp, Artificial Sequence
  Synthetic polynucleotide
gcaacttgaaattatatctg

SEQ ID NO: 4427 - DNA, 20 bp, Artificial Sequence
  Synthetic polynucleotide
gtagagaaagaagcagtgcc

SEQ ID NO: 4428 - DNA, 20 bp, Artificial Sequence
  Synthetic polynucleotide
ataggagaagatgatgtata

SEQ ID NO: 4429 - DNA, 20 bp, Artificial Sequence
  Synthetic polynucleotide
gcatacagtgatttgatgaa

SEQ ID NO: 4430 - DNA, 20 bp, Artificial Sequence
  Synthetic polynucleotide
gggggccctcctcttgctgc

SEQ ID NO: 4431 - DNA, 20 bp, Artificial Sequence
  Synthetic polynucleotide
gaaaatcatcagttatcatc

SEQ ID NO: 4432 - DNA, 20 bp, Artificial Sequence
  Synthetic polynucleotide
ttcatgagtcttgacaacaa

SEQ ID NO: 4433 - DNA, 20 bp, Artificial Sequence
  Synthetic polynucleotide
ggtggcgggcactgtcgtca

SEQ ID NO: 4434 - DNA, 20 bp, Artificial Sequence
  Synthetic polynucleotide
atgacagtgccaaagccagc

SEQ ID NO: 4435 - DNA, 20 bp, Artificial Sequence
  Synthetic polynucleotide
acagtagaactaagggtggg

SEQ ID NO: 4436 - DNA, 20 bp, Artificial Sequence
  Synthetic polynucleotide
ccgccgtccaagacctaccg

SEQ ID NO: 4437 - DNA, 20 bp, Artificial Sequence
  Synthetic polynucleotide
gggctgtcaggtccttgggg

SEQ ID NO: 4438 - DNA, 20 bp, Artificial Sequence
  Synthetic polynucleotide
accatgagtaactccattcc

SEQ ID NO: 4439 - DNA, 20 bp, Artificial Sequence
  Synthetic polynucleotide
ggaggtagagattcatgtca

SEQ ID NO: 4440 - DNA, 20 bp, Artificial Sequence
  Synthetic polynucleotide
gaacgaatacagaaaagtaa

SEQ ID NO: 4441 - DNA, 20 bp, Artificial Sequence
  Synthetic polynucleotide
atccgtggcccatcatgtct

SEQ ID NO: 4442 - DNA, 20 bp, Artificial Sequence
  Synthetic polynucleotide
ggtggacaagcggcagatag

SEQ ID NO: 4443 - DNA, 20 bp, Artificial Sequence
  Synthetic polynucleotide
gaactgcaaagtgaaacaaa

SEQ ID NO: 4444 - DNA, 20 bp, Artificial Sequence
  Synthetic polynucleotide
actgacacgcagacattcag

SEQ ID NO: 4445 - DNA, 20 bp, Artificial Sequence
  Synthetic polynucleotide
cgaagctggaatctgctctc

SEQ ID NO: 4446 - DNA, 20 bp, Artificial Sequence
  Synthetic polynucleotide
gaccagccggggcagtgaag

SEQ ID NO: 4447 - DNA, 20 bp, Artificial Sequence
  Synthetic polynucleotide
gagtatctggtaccccagca

SEQ ID NO: 4448 - DNA, 20 bp, Artificial Sequence
  Synthetic polynucleotide
ctgggcaggcgacccgccgc

SEQ ID NO: 4449 - DNA, 20 bp, Artificial Sequence
  Synthetic polynucleotide
gttctccacggcacccccaa

SEQ ID NO: 4450 - DNA, 20 bp, Artificial Sequence
  Synthetic polynucleotide
gagaaagaataccatgcaga

SEQ ID NO: 4451 - DNA, 20 bp, Artificial Sequence
  Synthetic polynucleotide
ctcctcctctgctccgccac

SEQ ID NO: 4452 - DNA, 20 bp, Artificial Sequence
  Synthetic polynucleotide
gctcaggaggaggaagccgg

SEQ ID NO: 4453 - DNA, 20 bp, Artificial Sequence
  Synthetic polynucleotide
gctgaggaggggtcgcggcg

SEQ ID NO: 4454 - DNA, 20 bp, Artificial Sequence
  Synthetic polynucleotide
caagctgtttgccaaagagg

SEQ ID NO: 4455 - DNA, 20 bp, Artificial Sequence
  Synthetic polynucleotide
gcacgcagcggcgggagccc

SEQ ID NO: 4456 - DNA, 20 bp, Artificial Sequence
  Synthetic polynucleotide
ggcccccaagtggacagagc

SEQ ID NO: 4457 - DNA, 20 bp, Artificial Sequence
  Synthetic polynucleotide
ggaagggctaggcgggggcg

SEQ ID NO: 4458 - DNA, 20 bp, Artificial Sequence
  Synthetic polynucleotide
gcaaataaccttctgtgtca

SEQ ID NO: 4459 - DNA, 20 bp, Artificial Sequence
  Synthetic polynucleotide
gcaccaagtctgagtggacc

SEQ ID NO: 4460 - DNA, 20 bp, Artificial Sequence
  Synthetic polynucleotide
gcaggactcctttcctccat

SEQ ID NO: 4461 - DNA, 20 bp, Artificial Sequence
  Synthetic polynucleotide
gctgcgcctctgctgcgcct

SEQ ID NO: 4462 - DNA, 20 bp, Artificial Sequence
  Synthetic polynucleotide
gaagccagctgattataaga

SEQ ID NO: 4463 - DNA, 20 bp, Artificial Sequence
  Synthetic polynucleotide
ccaaaaaagaactgcacctc

SEQ ID NO: 4464 - DNA, 20 bp, Artificial Sequence
  Synthetic polynucleotide
gttcgactacgtggagaagc

SEQ ID NO: 4465 - DNA, 20 bp, Artificial Sequence
  Synthetic polynucleotide
cgaccaaagcgcctgaggac

SEQ ID NO: 4466 - DNA, 20 bp, Artificial Sequence
  Synthetic polynucleotide
cctggccacagcctacatcc

SEQ ID NO: 4467 - DNA, 20 bp, Artificial Sequence
  Synthetic polynucleotide
ggcactgacaatcccctttc

SEQ ID NO: 4468 - DNA, 20 bp, Artificial Sequence
  Synthetic polynucleotide
gaggagctccaagaagactg

SEQ ID NO: 4469 - DNA, 20 bp, Artificial Sequence
  Synthetic polynucleotide
gaagaagacaaatcacaaac

SEQ ID NO: 4470 - DNA, 20 bp, Artificial Sequence
  Synthetic polynucleotide
ggggcgggaagagcgcgtcc

SEQ ID NO: 4471 - DNA, 20 bp, Artificial Sequence
  Synthetic polynucleotide
ctcgtctgataagacaacag

SEQ ID NO: 4472 - DNA, 20 bp, Artificial Sequence
  Synthetic polynucleotide
gtgaatagagccagcaaagg

SEQ ID NO: 4473 - DNA, 20 bp, Artificial Sequence
  Synthetic polynucleotide
gactcgcagacgccctctgc

SEQ ID NO: 4474 - DNA, 20 bp, Artificial Sequence
  Synthetic polynucleotide
ttgtcgtcttctgtccaagt

SEQ ID NO: 4475 - DNA, 20 bp, Artificial Sequence
  Synthetic polynucleotide
gaggcgcagcagtgccacag

SEQ ID NO: 4476 - DNA, 20 bp, Artificial Sequence
  Synthetic polynucleotide
ggccatggcgggctggatcc

SEQ ID NO: 4477 - DNA, 20 bp, Artificial Sequence
  Synthetic polynucleotide
gagccaagatggggctctgc

SEQ ID NO: 4478 - DNA, 20 bp, Artificial Sequence
  Synthetic polynucleotide
gggtggggggagtttgctcc

SEQ ID NO: 4479 - DNA, 20 bp, Artificial Sequence
  Synthetic polynucleotide
gccgaggctgctggaggaag

SEQ ID NO: 4480 - DNA, 20 bp, Artificial Sequence
  Synthetic polynucleotide
gcaaaactcaaccctacccc

SEQ ID NO: 4481 - DNA, 20 bp, Artificial Sequence
  Synthetic polynucleotide
gaatccatcttcctgaccct

SEQ ID NO: 4482 - DNA, 20 bp, Artificial Sequence
  Synthetic polynucleotide
ctaggtgatgatgtcagatt

SEQ ID NO: 4483 - DNA, 20 bp, Artificial Sequence
  Synthetic polynucleotide
gagcagagatgtgggaatgg

SEQ ID NO: 4484 - DNA, 20 bp, Artificial Sequence
  Synthetic polynucleotide
gggactggggtcgggagggt

SEQ ID NO: 4485 - DNA, 20 bp, Artificial Sequence
  Synthetic polynucleotide
gagaaagctggagaaggggg

SEQ ID NO: 4486 - DNA, 20 bp, Artificial Sequence
  Synthetic polynucleotide
gcgcagggaagcgaccaact

SEQ ID NO: 4487 - DNA, 20 bp, Artificial Sequence
  Synthetic polynucleotide
gaagagggggagagagttac

SEQ ID NO: 4488 - DNA, 20 bp, Artificial Sequence
  Synthetic polynucleotide
gtggaagagtttgtggaagg

SEQ ID NO: 4489 - DNA, 20 bp, Artificial Sequence
  Synthetic polynucleotide
agttcccagctgcacgcctc

SEQ ID NO: 4490 - DNA, 20 bp, Artificial Sequence
  Synthetic polynucleotide
gaagagggaaacgtgtggct

SEQ ID NO: 4491 - DNA, 20 bp, Artificial Sequence
  Synthetic polynucleotide
ggtgggtctcgggactggca

SEQ ID NO: 4492 - DNA, 20 bp, Artificial Sequence
  Synthetic polynucleotide
gaatgagggtcctttgggaa

SEQ ID NO: 4493 - DNA, 20 bp, Artificial Sequence
  Synthetic polynucleotide
ggtgggggcggaagggggcc

SEQ ID NO: 4494 - DNA, 20 bp, Artificial Sequence
  Synthetic polynucleotide
cggccagagaccgagcccta

SEQ ID NO: 4495 - DNA, 20 bp, Artificial Sequence
  Synthetic polynucleotide
gttgtggcagcagtcactgg

SEQ ID NO: 4496 - DNA, 20 bp, Artificial Sequence
  Synthetic polynucleotide
caacagcagcagccacctgg

SEQ ID NO: 4497 - DNA, 20 bp, Artificial Sequence
  Synthetic polynucleotide
ggagccagcccctggccttc

SEQ ID NO: 4498 - DNA, 20 bp, Artificial Sequence
  Synthetic polynucleotide
tcccaaaggcggagggcgtt

SEQ ID NO: 4499 - DNA, 20 bp, Artificial Sequence
  Synthetic polynucleotide
tgagtccgagcagaagaaga

SEQ ID NO: 4500 - DNA, 20 bp, Artificial Sequence
  Synthetic polynucleotide
gagtccgagcagaagaagaa

SEQ ID NO: 4501 - DNA, 20 bp, Artificial Sequence
  Synthetic polynucleotide
ggcagccagcatgatgagac

SEQ ID NO: 4502 - DNA, 20 bp, Artificial Sequence
  Synthetic polynucleotide
cttctttgcttgttcaaatg

SEQ ID NO: 4503 - DNA, 20 bp, Artificial Sequence
  Synthetic polynucleotide
gcagggtgagtgtctcagcc

SEQ ID NO: 4504 - DNA, 20 bp, Artificial Sequence
  Synthetic polynucleotide
gaactgtgtgtgttgcaggg

SEQ ID NO: 4505 - DNA, 20 bp, Artificial Sequence
  Synthetic polynucleotide
gggctgagagagggacaagt

SEQ ID NO: 4506 - DNA, 20 bp, Artificial Sequence
  Synthetic polynucleotide
aaaacgtttccaagacatga

SEQ ID NO: 4507 - DNA, 20 bp, Artificial Sequence
  Synthetic polynucleotide
ccacgcccgcggggtgaagt

SEQ ID NO: 4508 - DNA, 20 bp, Artificial Sequence
  Synthetic polynucleotide
ccttccagcagcagcagcag

SEQ ID NO: 4509 - DNA, 20 bp, Artificial Sequence
  Synthetic polynucleotide
agtccttccagcagcagcag

SEQ ID NO: 4510 - DNA, 20 bp, Artificial Sequence
  Synthetic polynucleotide
tcaagtccttccagcagcag

SEQ ID NO: 4511 - DNA, 20 bp, Artificial Sequence
  Synthetic polynucleotide
ccctcaagtccttccagcag

SEQ ID NO: 4512 - DNA, 20 bp, Artificial Sequence
  Synthetic polynucleotide
gatccccccagcagcagcag

SEQ ID NO: 4513 - DNA, 20 bp, Artificial Sequence
  Synthetic polynucleotide
tgtgatccccccagcagcag

SEQ ID NO: 4514 - DNA, 20 bp, Artificial Sequence
  Synthetic polynucleotide
gtctgtgatccccccagcag

SEQ ID NO: 4515 - DNA, 20 bp, Artificial Sequence
  Synthetic polynucleotide
gtttgctgctgctgcagcag

SEQ ID NO: 4516 - DNA, 20 bp, Artificial Sequence
  Synthetic polynucleotide
cggcagcgcggcggcggcgg

SEQ ID NO: 4517 - DNA, 20 bp, Artificial Sequence
  Synthetic polynucleotide
gtgcggcagcgcggcggcgg

SEQ ID NO: 4518 - DNA, 20 bp, Artificial Sequence
  Synthetic polynucleotide
ggcgtgcggcagcgcggcgg

SEQ ID NO: 4519 - DNA, 20 bp, Artificial Sequence
  Synthetic polynucleotide
catttagtgctgctctatgc

SEQ ID NO: 4520 - DNA, 20 bp, Artificial Sequence
  Synthetic polynucleotide
caggaaatgctggcatagag

SEQ ID NO: 4521 - DNA, 20 bp, Artificial Sequence
  Synthetic polynucleotide
ttgcaggaaatgctggcata

SEQ ID NO: 4522 - DNA, 20 bp, Artificial Sequence
  Synthetic polynucleotide
tttgcaggaaatgctggcat

SEQ ID NO: 4523 - DNA, 20 bp, Artificial Sequence
  Synthetic polynucleotide
atttgcaggaaatgctggca

SEQ ID NO: 4524 - DNA, 20 bp, Artificial Sequence
  Synthetic polynucleotide
ttctcatttgcaggaaatgc

SEQ ID NO: 4525 - DNA, 20 bp, Artificial Sequence
  Synthetic polynucleotide
actaacatcacaaggtgata

SEQ ID NO: 4526 - DNA, 20 bp, Artificial Sequence
  Synthetic polynucleotide
ttgtccttgcagtcggcagt

SEQ ID NO: 4527 - DNA, 20 bp, Artificial Sequence
  Synthetic polynucleotide
gcaggtccagcaaccaacca

SEQ ID NO: 4528 - DNA, 20 bp, Artificial Sequence
  Synthetic polynucleotide
acagcttcagcgagccgagc

SEQ ID NO: 4529 - DNA, 20 bp, Artificial Sequence
  Synthetic polynucleotide
ccctcctacaggaccgacca

SEQ ID NO: 4530 - DNA, 20 bp, Artificial Sequence
  Synthetic polynucleotide
gctggtccagctggtccagc

SEQ ID NO: 4531 - DNA, 20 bp, Artificial Sequence
  Synthetic polynucleotide
tgacacagaaaagagaggag

SEQ ID NO: 4532 - DNA, 20 bp, Artificial Sequence
  Synthetic polynucleotide
ttaggtgggcttagatttgt

SEQ ID NO: 4533 - DNA, 20 bp, Artificial Sequence
  Synthetic polynucleotide
gctagtatggaggatctggg

SEQ ID NO: 4534 - DNA, 20 bp, Artificial Sequence
  Synthetic polynucleotide
ggaggaggaggaggaggagg

SEQ ID NO: 4535 - DNA, 20 bp, Artificial Sequence
  Synthetic polynucleotide
ggggcgggggatggtggtgg

SEQ ID NO: 4536 - DNA, 20 bp, Artificial Sequence
  Synthetic polynucleotide
catgaacatgagcggcatgg

SEQ ID NO: 4537 - DNA, 20 bp, Artificial Sequence
  Synthetic polynucleotide
ttgtgccacatggctccaca

SEQ ID NO: 4538 - DNA, 20 bp, Artificial Sequence
  Synthetic polynucleotide
gtaaatgttaccaggaggtc

SEQ ID NO: 4539 - DNA, 20 bp, Artificial Sequence
  Synthetic polynucleotide
acgcttgcagccccgggccc

SEQ ID NO: 4540 - DNA, 20 bp, Artificial Sequence
  Synthetic polynucleotide
ggaagaggaggaggaggagg

SEQ ID NO: 4541 - DNA, 20 bp, Artificial Sequence
  Synthetic polynucleotide
agcactggcacagccagcac

SEQ ID NO: 4542 - DNA, 20 bp, Artificial Sequence
  Synthetic polynucleotide
gcggcgggggcggcggcggg

SEQ ID NO: 4543 - DNA, 20 bp, Artificial Sequence
  Synthetic polynucleotide
gaggccaaagaaacccaccc

SEQ ID NO: 4544 - DNA, 20 bp, Artificial Sequence
  Synthetic polynucleotide
cggctccgggactgggcccc

SEQ ID NO: 4545 - DNA, 20 bp, Artificial Sequence
  Synthetic polynucleotide
ggaactgacagagacttgtg

SEQ ID NO: 4546 - DNA, 20 bp, Artificial Sequence
  Synthetic polynucleotide
aacttgatccactgattgat

SEQ ID NO: 4547 - DNA, 20 bp, Artificial Sequence
  Synthetic polynucleotide
gggggtcctgctggtggagg

SEQ ID NO: 4548 - DNA, 20 bp, Artificial Sequence
  Synthetic polynucleotide
gtcgccccggggccgccccg

SEQ ID NO: 4549 - DNA, 20 bp, Artificial Sequence
  Synthetic polynucleotide
aagaagaggaagaagaggga

SEQ ID NO: 4550 - DNA, 20 bp, Artificial Sequence
  Synthetic polynucleotide
tggaggtgcggaagcggaag

SEQ ID NO: 4551 - DNA, 20 bp, Artificial Sequence
  Synthetic polynucleotide
ctgtgtgttaacactagcta

SEQ ID NO: 4552 - DNA, 20 bp, Artificial Sequence
  Synthetic polynucleotide
gaatatcgtgtagagataga

SEQ ID NO: 4553 - DNA, 20 bp, Artificial Sequence
  Synthetic polynucleotide
agtcattactagggaaggga

SEQ ID NO: 4554 - DNA, 20 bp, Artificial Sequence
  Synthetic polynucleotide
agcagcagccccttggccct

SEQ ID NO: 4555 - DNA, 20 bp, Artificial Sequence
  Synthetic polynucleotide
agacaaaaggaggatcaagg

SEQ ID NO: 4556 - DNA, 20 bp, Artificial Sequence
  Synthetic polynucleotide
tattttacactcatggttca

SEQ ID NO: 4557 - DNA, 20 bp, Artificial Sequence
  Synthetic polynucleotide
catgtcccaatggatactta

SEQ ID NO: 4558 - DNA, 20 bp, Artificial Sequence
  Synthetic polynucleotide
gcgactgggtgcgctggcgc

SEQ ID NO: 4559 - DNA, 20 bp, Artificial Sequence
  Synthetic polynucleotide
cagaaaggccttctggattc

SEQ ID NO: 4560 - DNA, 20 bp, Artificial Sequence
  Synthetic polynucleotide
ggccgtttgagggacaggtg

SEQ ID NO: 4561 - DNA, 20 bp, Artificial Sequence
  Synthetic polynucleotide
gctggagtgtgaggagtgtg

SEQ ID NO: 4562 - DNA, 20 bp, Artificial Sequence
  Synthetic polynucleotide
tgtgaactatggtgcatata

SEQ ID NO: 4563 - DNA, 20 bp, Artificial Sequence
  Synthetic polynucleotide
tcgggagctggagctggagc

SEQ ID NO: 4564 - DNA, 20 bp, Artificial Sequence
  Synthetic polynucleotide
tcctccgctcggcgcggcgg

SEQ ID NO: 4565 - DNA, 20 bp, Artificial Sequence
  Synthetic polynucleotide
ttggcagtggtggcatgagg

SEQ ID NO: 4566 - DNA, 20 bp, Artificial Sequence
  Synthetic polynucleotide
taccagcccgacgagggacg

SEQ ID NO: 4567 - DNA, 20 bp, Artificial Sequence
  Synthetic polynucleotide
tagtcacatgattggcagat

SEQ ID NO: 4568 - DNA, 20 bp, Artificial Sequence
  Synthetic polynucleotide
tgcgagagctgcggcagctg

SEQ ID NO: 4569 - DNA, 20 bp, Artificial Sequence
  Synthetic polynucleotide
ctcaactccggcatcggcat

SEQ ID NO: 4570 - DNA, 20 bp, Artificial Sequence
  Synthetic polynucleotide
gggtacaggtcctcctgaac

SEQ ID NO: 4571 - DNA, 20 bp, Artificial Sequence
  Synthetic polynucleotide
ttgcccttggtgagcacgct

SEQ ID NO: 4572 - DNA, 20 bp, Artificial Sequence
  Synthetic polynucleotide
cttggtgactgagttgggct

SEQ ID NO: 4573 - DNA, 20 bp, Artificial Sequence
  Synthetic polynucleotide
agcagcagcggcggcggcgg

SEQ ID NO: 4574 - DNA, 20 bp, Artificial Sequence
  Synthetic polynucleotide
acatcatgtgcggggatgcg

SEQ ID NO: 4575 - DNA, 20 bp, Artificial Sequence
  Synthetic polynucleotide
tcattgactatttcattgac

SEQ ID NO: 4576 - DNA, 20 bp, Artificial Sequence
  Synthetic polynucleotide
ataaacacagagggagtgag

SEQ ID NO: 4577 - DNA, 20 bp, Artificial Sequence
  Synthetic polynucleotide
gccaggtagcccaggttggt

SEQ ID NO: 4578 - DNA, 20 bp, Artificial Sequence
  Synthetic polynucleotide
gaagatggcggcagcggcag

SEQ ID NO: 4579 - DNA, 20 bp, Artificial Sequence
  Synthetic polynucleotide
cttcctgctgcggctccgag

SEQ ID NO: 4580 - DNA, 20 bp, Artificial Sequence
  Synthetic polynucleotide
agtggcaatggcaatggcaa

SEQ ID NO: 4581 - DNA, 20 bp, Artificial Sequence
  Synthetic polynucleotide
cagcttcccccgctttcggt

SEQ ID NO: 4582 - DNA, 20 bp, Artificial Sequence
  Synthetic polynucleotide
gaggaggaagaagaggaaag

SEQ ID NO: 4583 - DNA, 20 bp, Artificial Sequence
  Synthetic polynucleotide
gcggcgggggcggcggcagg

SEQ ID NO: 4584 - DNA, 20 bp, Artificial Sequence
  Synthetic polynucleotide
ccagctcgcgcaggctgcgc

SEQ ID NO: 4585 - DNA, 20 bp, Artificial Sequence
  Synthetic polynucleotide
cggaagagcagggagtaagt

SEQ ID NO: 4586 - DNA, 20 bp, Artificial Sequence
  Synthetic polynucleotide
gctgcggacgccgggacgcc

SEQ ID NO: 4587 - DNA, 20 bp, Artificial Sequence
  Synthetic polynucleotide
aagactgctcagggctactc

SEQ ID NO: 4588 - DNA, 20 bp, Artificial Sequence
  Synthetic polynucleotide
tgtctctcttggcagtcagt

SEQ ID NO: 4589 - DNA, 20 bp, Artificial Sequence
  Synthetic polynucleotide
ccgtgctcctggggctgggc

SEQ ID NO: 4590 - DNA, 20 bp, Artificial Sequence
  Synthetic polynucleotide
cgccccctcgcggtgcggtg

SEQ ID NO: 4591 - DNA, 20 bp, Artificial Sequence
  Synthetic polynucleotide
gtgcccagccagccagccag

SEQ ID NO: 4592 - DNA, 20 bp, Artificial Sequence
  Synthetic polynucleotide
aaaatctgctagaggaaaag

SEQ ID NO: 4593 - DNA, 20 bp, Artificial Sequence
  Synthetic polynucleotide
gccctccgtcagcagcagca

SEQ ID NO: 4594 - DNA, 20 bp, Artificial Sequence
  Synthetic polynucleotide
gatggaggggccggactgga

SEQ ID NO: 4595 - DNA, 20 bp, Artificial Sequence
  Synthetic polynucleotide
gccttcagcgccaggatctc

SEQ ID NO: 4596 - DNA, 20 bp, Artificial Sequence
  Synthetic polynucleotide
ccacactggcaagtccacac

SEQ ID NO: 4597 - DNA, 20 bp, Artificial Sequence
  Synthetic polynucleotide
gagacggagggggagcaagc

SEQ ID NO: 4598 - DNA, 20 bp, Artificial Sequence
  Synthetic polynucleotide
cagtgtatcgctcccggccc

SEQ ID NO: 4599 - DNA, 20 bp, Artificial Sequence
  Synthetic polynucleotide
ttaggatctgaatccagtcc

SEQ ID NO: 4600 - DNA, 20 bp, Artificial Sequence
  Synthetic polynucleotide
cgctctcgggcattgattgt

SEQ ID NO: 4601 - DNA, 20 bp, Artificial Sequence
  Synthetic polynucleotide
catgatctctggaggaagcg

SEQ ID NO: 4602 - DNA, 20 bp, Artificial Sequence
  Synthetic polynucleotide
agctgcgccacgggctgggc

SEQ ID NO: 4603 - DNA, 20 bp, Artificial Sequence
  Synthetic polynucleotide
ccggcggcggaagctcccgg

SEQ ID NO: 4604 - DNA, 20 bp, Artificial Sequence
  Synthetic polynucleotide
tgcggtgccgggggcggcgg

SEQ ID NO: 4605 - DNA, 20 bp, Artificial Sequence
  Synthetic polynucleotide
aaggtgaagcagcatctatc

SEQ ID NO: 4606 - DNA, 20 bp, Artificial Sequence
  Synthetic polynucleotide
aagattctgatgtggaatgg

SEQ ID NO: 4607 - DNA, 20 bp, Artificial Sequence
  Synthetic polynucleotide
gaaaaagagaggaggagggg

SEQ ID NO: 4608 - DNA, 20 bp, Artificial Sequence
  Synthetic polynucleotide
aggtactacgagaccgagac

SEQ ID NO: 4609 - DNA, 20 bp, Artificial Sequence
  Synthetic polynucleotide
ggcaggggacgcccggctcg

SEQ ID NO: 4610 - DNA, 20 bp, Artificial Sequence
  Synthetic polynucleotide
caaccagaagaagaagaaga

SEQ ID NO: 4611 - DNA, 20 bp, Artificial Sequence
  Synthetic polynucleotide
aaaggaaatgcagcagtatg

SEQ ID NO: 4612 - DNA, 20 bp, Artificial Sequence
  Synthetic polynucleotide
gagcttgctcctttctttct

SEQ ID NO: 4613 - DNA, 20 bp, Artificial Sequence
  Synthetic polynucleotide
agtggtactgcgaatggtgg

SEQ ID NO: 4614 - DNA, 20 bp, Artificial Sequence
  Synthetic polynucleotide
gatacatcccagactagact

SEQ ID NO: 4615 - DNA, 20 bp, Artificial Sequence
  Synthetic polynucleotide
ggcggcggcggcggcggcgg

SEQ ID NO: 4616 - DNA, 20 bp, Artificial Sequence
  Synthetic polynucleotide
gccacgccagggtactactg

SEQ ID NO: 4617 - DNA, 20 bp, Artificial Sequence
  Synthetic polynucleotide
ttgccctgggactccagcct

SEQ ID NO: 4618 - DNA, 20 bp, Artificial Sequence
  Synthetic polynucleotide
gcagaccctccgagcagagc

SEQ ID NO: 4619 - DNA, 20 bp, Artificial Sequence
  Synthetic polynucleotide
aggagctgtgcacgacgaca

SEQ ID NO: 4620 - DNA, 20 bp, Artificial Sequence
  Synthetic polynucleotide
ttgtagatggccatggccca

SEQ ID NO: 4621 - DNA, 20 bp, Artificial Sequence
  Synthetic polynucleotide
aattttgaatggataatgaa

SEQ ID NO: 4622 - DNA, 20 bp, Artificial Sequence
  Synthetic polynucleotide
ttgcaggggaagaacagaac

SEQ ID NO: 4623 - DNA, 20 bp, Artificial Sequence
  Synthetic polynucleotide
gtgctcagcattggcagcat

SEQ ID NO: 4624 - DNA, 20 bp, Artificial Sequence
  Synthetic polynucleotide
catgcccttctaaaggttaa

SEQ ID NO: 4625 - DNA, 20 bp, Artificial Sequence
  Synthetic polynucleotide
acatctactcgctggtgagc

SEQ ID NO: 4626 - DNA, 20 bp, Artificial Sequence
  Synthetic polynucleotide
tactaatgaatggtagtgaa

SEQ ID NO: 4627 - DNA, 20 bp, Artificial Sequence
  Synthetic polynucleotide
ctgtccctggcttttatccc

SEQ ID NO: 4628 - DNA, 20 bp, Artificial Sequence
  Synthetic polynucleotide
gaagaagaagaagaagaaga

SEQ ID NO: 4629 - DNA, 20 bp, Artificial Sequence
  Synthetic polynucleotide
tcagaaggggtaatccagaa

SEQ ID NO: 4630 - DNA, 20 bp, Artificial Sequence
  Synthetic polynucleotide
ctgatgtgctttgttctttc

SEQ ID NO: 4631 - DNA, 20 bp, Artificial Sequence
  Synthetic polynucleotide
gacggcatgctgctggctgc

SEQ ID NO: 4632 - DNA, 20 bp, Artificial Sequence
  Synthetic polynucleotide
ctgctgctgctgctgctcct

SEQ ID NO: 4633 - DNA, 20 bp, Artificial Sequence
  Synthetic polynucleotide
atacgaccccactatagaag

SEQ ID NO: 4634 - DNA, 20 bp, Artificial Sequence
  Synthetic polynucleotide
ggccaggatgggcagcaagc

SEQ ID NO: 4635 - DNA, 20 bp, Artificial Sequence
  Synthetic polynucleotide
aaggtgacagtgcctgcctg

SEQ ID NO: 4636 - DNA, 20 bp, Artificial Sequence
  Synthetic polynucleotide
agcggaggaggaggaggagg

SEQ ID NO: 4637 - DNA, 20 bp, Artificial Sequence
  Synthetic polynucleotide
tcaccgtgcggcacagctcg

SEQ ID NO: 4638 - DNA, 20 bp, Artificial Sequence
  Synthetic polynucleotide
cccttcccagtgaggcaggc

SEQ ID NO: 4639 - DNA, 20 bp, Artificial Sequence
  Synthetic polynucleotide
atgatggctggcatgatggc

SEQ ID NO: 4640 - DNA, 20 bp, Artificial Sequence
  Synthetic polynucleotide
tctcggtgatgagcagcagc

SEQ ID NO: 4641 - DNA, 20 bp, Artificial Sequence
  Synthetic polynucleotide
ggtcaactggtagacacaac

SEQ ID NO: 4642 - DNA, 20 bp, Artificial Sequence
  Synthetic polynucleotide
tttatagttatgaggaaatg

SEQ ID NO: 4643 - DNA, 20 bp, Artificial Sequence
  Synthetic polynucleotide
gcgaagatggctcggaggct

SEQ ID NO: 4644 - DNA, 20 bp, Artificial Sequence
  Synthetic polynucleotide
gagctggcccggcggcggcc

SEQ ID NO: 4645 - DNA, 20 bp, Artificial Sequence
  Synthetic polynucleotide
ggcggcggcggcggcggcgg

SEQ ID NO: 4646 - DNA, 20 bp, Artificial Sequence
  Synthetic polynucleotide
ctgcagaaggtgactgcaga

SEQ ID NO: 4647 - DNA, 20 bp, Artificial Sequence
  Synthetic polynucleotide
tgtccttttgctccaggcag

SEQ ID NO: 4648 - DNA, 20 bp, Artificial Sequence
  Synthetic polynucleotide
caatataactggataataac

SEQ ID NO: 4649 - DNA, 20 bp, Artificial Sequence
  Synthetic polynucleotide
gatgatgatgatgatgatga

SEQ ID NO: 4650 - DNA, 20 bp, Artificial Sequence
  Synthetic polynucleotide
ccaggtatttcttgctgtgc

SEQ ID NO: 4651 - DNA, 20 bp, Artificial Sequence
  Synthetic polynucleotide
acatggtggagagtggaagg

SEQ ID NO: 4652 - DNA, 20 bp, Artificial Sequence
  Synthetic polynucleotide
ttgctggtgaagtggttaag

SEQ ID NO: 4653 - DNA, 20 bp, Artificial Sequence
  Synthetic polynucleotide
ctgaggaatgcagaatgcag

SEQ ID NO: 4654 - DNA, 20 bp, Artificial Sequence
  Synthetic polynucleotide
acacaggagctgtttctttc

SEQ ID NO: 4655 - DNA, 20 bp, Artificial Sequence
  Synthetic polynucleotide
ttttgcaagaatttatcatc

SEQ ID NO: 4656 - DNA, 20 bp, Artificial Sequence
  Synthetic polynucleotide
acagcacctccggggggcgg

SEQ ID NO: 4657 - DNA, 20 bp, Artificial Sequence
  Synthetic polynucleotide
cgcgggcaggcagacggggg

SEQ ID NO: 4658 - DNA, 20 bp, Artificial Sequence
  Synthetic polynucleotide
ggcggcggcggcggcggcgg

SEQ ID NO: 4659 - DNA, 20 bp, Artificial Sequence
  Synthetic polynucleotide
cgctgcttcgtgcggctggc

SEQ ID NO: 4660 - DNA, 20 bp, Artificial Sequence
  Synthetic polynucleotide
gcccatgatggcagaggcag

SEQ ID NO: 4661 - DNA, 20 bp, Artificial Sequence
  Synthetic polynucleotide
tggcggaggcggcggcgcgg

SEQ ID NO: 4662 - DNA, 20 bp, Artificial Sequence
  Synthetic polynucleotide
gctgaacattggctgaacat

SEQ ID NO: 4663 - DNA, 20 bp, Artificial Sequence
  Synthetic polynucleotide
ctcaccaccccctggaggga

SEQ ID NO: 4664 - DNA, 20 bp, Artificial Sequence
  Synthetic polynucleotide
ccagacactacaacaacaac

SEQ ID NO: 4665 - DNA, 20 bp, Artificial Sequence
  Synthetic polynucleotide
cctggtactcctgggtctcc

SEQ ID NO: 4666 - DNA, 20 bp, Artificial Sequence
  Synthetic polynucleotide
cggcccggcggcacacggcc

SEQ ID NO: 4667 - DNA, 20 bp, Artificial Sequence
  Synthetic polynucleotide
ggcggcggcggcggcggcgg

SEQ ID NO: 4668 - DNA, 20 bp, Artificial Sequence
  Synthetic polynucleotide
ggcggcggcggcggcggcgg

SEQ ID NO: 4669 - DNA, 20 bp, Artificial Sequence
  Synthetic polynucleotide
gagagctgcggctgcggctg

SEQ ID NO: 4670 - DNA, 20 bp, Artificial Sequence
  Synthetic polynucleotide
cagcttgaaggcagcggcgg

SEQ ID NO: 4671 - DNA, 20 bp, Artificial Sequence
  Synthetic polynucleotide
ccctgcggcgctaagtaaga

SEQ ID NO: 4672 - DNA, 20 bp, Artificial Sequence
  Synthetic polynucleotide
gcggccgggtcgatgtaggt

SEQ ID NO: 4673 - DNA, 20 bp, Artificial Sequence
  Synthetic polynucleotide
gccgcgtccggggccggggc

SEQ ID NO: 4674 - DNA, 20 bp, Artificial Sequence
  Synthetic polynucleotide
gtccatcacgtcgtagggca

SEQ ID NO: 4675 - DNA, 20 bp, Artificial Sequence
  Synthetic polynucleotide
agcggaggaggaggaggagg

SEQ ID NO: 4676 - DNA, 20 bp, Artificial Sequence
  Synthetic polynucleotide
tgcagacgaggacgaggacg

SEQ ID NO: 4677 - DNA, 20 bp, Artificial Sequence
  Synthetic polynucleotide
ccagcgacgggcagcggcgg

SEQ ID NO: 4678 - DNA, 20 bp, Artificial Sequence
  Synthetic polynucleotide
cttcgaggccgaggaggagg

SEQ ID NO: 4679 - DNA, 20 bp, Artificial Sequence
  Synthetic polynucleotide
tggagtcatttttgttgtgt

SEQ ID NO: 4680 - DNA, 20 bp, Artificial Sequence
  Synthetic polynucleotide
gtgaccgcttgaactggctg

SEQ ID NO: 4681 - DNA, 20 bp, Artificial Sequence
  Synthetic polynucleotide
gcggggcggctggcccgccc

SEQ ID NO: 4682 - DNA, 20 bp, Artificial Sequence
  Synthetic polynucleotide
aggtaacccaggagaaagtc

SEQ ID NO: 4683 - DNA, 20 bp, Artificial Sequence
  Synthetic polynucleotide
ggcccccgctgctggcaggc

SEQ ID NO: 4684 - DNA, 20 bp, Artificial Sequence
  Synthetic polynucleotide
gagggtcggcctcagctttt

SEQ ID NO: 4685 - DNA, 20 bp, Artificial Sequence
  Synthetic polynucleotide
cgccgctaccggctcgccac

SEQ ID NO: 4686 - DNA, 20 bp, Artificial Sequence
  Synthetic polynucleotide
cctgtggcctgctgcctgcc

SEQ ID NO: 4687 - DNA, 20 bp, Artificial Sequence
  Synthetic polynucleotide
aaacgccccggcaggaagcc

SEQ ID NO: 4688 - DNA, 20 bp, Artificial Sequence
  Synthetic polynucleotide
atacgaccccactatagagg

SEQ ID NO: 4689 - DNA, 20 bp, Artificial Sequence
  Synthetic polynucleotide
agcgagcgcgcctggcgggc

SEQ ID NO: 4690 - DNA, 20 bp, Artificial Sequence
  Synthetic polynucleotide
ctctctctctctctctctgc

SEQ ID NO: 4691 - DNA, 20 bp, Artificial Sequence
  Synthetic polynucleotide
cgactgcaaggacaaatctg

SEQ ID NO: 4692 - DNA, 20 bp, Artificial Sequence
  Synthetic polynucleotide
cgctcctggctggcgcggcg

SEQ ID NO: 4693 - DNA, 20 bp, Artificial Sequence
  Synthetic polynucleotide
ctaaaaatttgctgaagtga

SEQ ID NO: 4694 - DNA, 20 bp, Artificial Sequence
  Synthetic polynucleotide
cgccacgggctgggccgggc

SEQ ID NO: 4695 - DNA, 20 bp, Artificial Sequence
  Synthetic polynucleotide
tcagggcccgcagcaacaac

SEQ ID NO: 4696 - DNA, 20 bp, Artificial Sequence
  Synthetic polynucleotide
ggaggaggaggaggaggagg

SEQ ID NO: 4697 - DNA, 20 bp, Artificial Sequence
  Synthetic polynucleotide
ccacacgggccttgacgtac

SEQ ID NO: 4698 - DNA, 20 bp, Artificial Sequence
  Synthetic polynucleotide
gcaggacaacagatggctga

SEQ ID NO: 4699 - DNA, 20 bp, Artificial Sequence
  Synthetic polynucleotide
cctctttggctcttttcttc

SEQ ID NO: 4700 - DNA, 20 bp, Artificial Sequence
  Synthetic polynucleotide
aatgcaaccgaagcaggatg

SEQ ID NO: 4701 - DNA, 20 bp, Artificial Sequence
  Synthetic polynucleotide
cgatgacggcattggcgcat

SEQ ID NO: 4702 - DNA, 20 bp, Artificial Sequence
  Synthetic polynucleotide
ggcggctgctgctgctgctg

SEQ ID NO: 4703 - DNA, 20 bp, Artificial Sequence
  Synthetic polynucleotide
atcttcgcagtcttcgcagt

SEQ ID NO: 4704 - DNA, 20 bp, Artificial Sequence
  Synthetic polynucleotide
ggaggaggaggaggaggagg

SEQ ID NO: 4705 - DNA, 20 bp, Artificial Sequence
  Synthetic polynucleotide
tgggccgggccgggcagggc

SEQ ID NO: 4706 - DNA, 20 bp, Artificial Sequence
  Synthetic polynucleotide
ctgcggggccacggtcggtc

SEQ ID NO: 4707 - DNA, 20 bp, Artificial Sequence
  Synthetic polynucleotide
ggtggctggggcggcggcgg

SEQ ID NO: 4708 - DNA, 20 bp, Artificial Sequence
  Synthetic polynucleotide
ggcccggaacatggacggac

SEQ ID NO: 4709 - DNA, 20 bp, Artificial Sequence
  Synthetic polynucleotide
ggactctgagtggtgggtga

SEQ ID NO: 4710 - DNA, 20 bp, Artificial Sequence
  Synthetic polynucleotide
tattatgagactgtttgttt

SEQ ID NO: 4711 - DNA, 20 bp, Artificial Sequence
  Synthetic polynucleotide
cgcctcgcctcgcctcgcct

SEQ ID NO: 4712 - DNA, 20 bp, Artificial Sequence
  Synthetic polynucleotide
cagaggcagtgtggacagtg

SEQ ID NO: 4713 - DNA, 20 bp, Artificial Sequence
  Synthetic polynucleotide
cgctacctggcgcggctccc

SEQ ID NO: 4714 - DNA, 20 bp, Artificial Sequence
  Synthetic polynucleotide
aagtacgtggacaagctacg

SEQ ID NO: 4715 - DNA, 20 bp, Artificial Sequence
  Synthetic polynucleotide
agcttaaaaggactatgcta

SEQ ID NO: 4716 - DNA, 20 bp, Artificial Sequence
  Synthetic polynucleotide
gcgggggcgcggctggggcg

SEQ ID NO: 4717 - DNA, 20 bp, Artificial Sequence
  Synthetic polynucleotide
tacctcacggtgggccttca

SEQ ID NO: 4718 - DNA, 20 bp, Artificial Sequence
  Synthetic polynucleotide
gggcacacttgaagaaagaa

SEQ ID NO: 4719 - DNA, 20 bp, Artificial Sequence
  Synthetic polynucleotide
gcccctgcccctgctgactg

SEQ ID NO: 4720 - DNA, 20 bp, Artificial Sequence
  Synthetic polynucleotide
tggccctagtacctacctga

SEQ ID NO: 4721 - DNA, 20 bp, Artificial Sequence
  Synthetic polynucleotide
tgggccggggcggtttgggg

SEQ ID NO: 4722 - DNA, 20 bp, Artificial Sequence
  Synthetic polynucleotide
ggatgttgtgctgctgctgc

SEQ ID NO: 4723 - DNA, 20 bp, Artificial Sequence
  Synthetic polynucleotide
cgcggccagctgcgaggagg

SEQ ID NO: 4724 - DNA, 20 bp, Artificial Sequence
  Synthetic polynucleotide
gccgcgagaggttatgggag

SEQ ID NO: 4725 - DNA, 20 bp, Artificial Sequence
  Synthetic polynucleotide
aaactggagaaaaataggat

SEQ ID NO: 4726 - DNA, 20 bp, Artificial Sequence
  Synthetic polynucleotide
tcccctgccttgactggaac

SEQ ID NO: 4727 - DNA, 20 bp, Artificial Sequence
  Synthetic polynucleotide
ttctttaaacgagaaggaga

SEQ ID NO: 4728 - DNA, 20 bp, Artificial Sequence
  Synthetic polynucleotide
gtacgtggcgctcatcgccg

SEQ ID NO: 4729 - DNA, 20 bp, Artificial Sequence
  Synthetic polynucleotide
gctggaccagctgggccagc

SEQ ID NO: 4730 - DNA, 20 bp, Artificial Sequence
  Synthetic polynucleotide
aggtaggctcgggaaggcgg

SEQ ID NO: 4731 - DNA, 20 bp, Artificial Sequence
  Synthetic polynucleotide
gccgggcgcgatgggcgcga

SEQ ID NO: 4732 - DNA, 20 bp, Artificial Sequence
  Synthetic polynucleotide
tatcgaagtcgtcctcactc

SEQ ID NO: 4733 - DNA, 20 bp, Artificial Sequence
  Synthetic polynucleotide
ctctgcggcaagtccctctg

SEQ ID NO: 4734 - DNA, 20 bp, Artificial Sequence
  Synthetic polynucleotide
gaacctgggcaagctggacc

SEQ ID NO: 4735 - DNA, 20 bp, Artificial Sequence
  Synthetic polynucleotide
agtcaggcgaccggcggcgg

SEQ ID NO: 4736 - DNA, 20 bp, Artificial Sequence
  Synthetic polynucleotide
gtgggtgctgagggtgccga

SEQ ID NO: 4737 - DNA, 20 bp, Artificial Sequence
  Synthetic polynucleotide
ggtccacagacagcgggtgg

SEQ ID NO: 4738 - DNA, 20 bp, Artificial Sequence
  Synthetic polynucleotide
cgatcaccgtgcggcacgtg

SEQ ID NO: 4739 - DNA, 20 bp, Artificial Sequence
  Synthetic polynucleotide
agctctggcacagccagctc

SEQ ID NO: 4740 - DNA, 20 bp, Artificial Sequence
  Synthetic polynucleotide
aaaactgctgctgctgcctg

SEQ ID NO: 4741 - DNA, 20 bp, Artificial Sequence
  Synthetic polynucleotide
catgaacacgcgcacgggca

SEQ ID NO: 4742 - DNA, 20 bp, Artificial Sequence
  Synthetic polynucleotide
tctggaacacgtcagcgggc

SEQ ID NO: 4743 - DNA, 20 bp, Artificial Sequence
  Synthetic polynucleotide
ggcggcggcggcggcggcgg

SEQ ID NO: 4744 - DNA, 20 bp, Artificial Sequence
  Synthetic polynucleotide
gcccgcaactacctggaacc

SEQ ID NO: 4745 - DNA, 20 bp, Artificial Sequence
  Synthetic polynucleotide
ggtcacgctacctggcgacc

SEQ ID NO: 4746 - DNA, 20 bp, Artificial Sequence
  Synthetic polynucleotide
tctgagtggtggtgatgtgg

SEQ ID NO: 4747 - DNA, 20 bp, Artificial Sequence
  Synthetic polynucleotide
tgctctggactcgtgctctc

SEQ ID NO: 4748 - DNA, 20 bp, Artificial Sequence
  Synthetic polynucleotide
tttggatcctaggtagatga

SEQ ID NO: 4749 - DNA, 20 bp, Artificial Sequence
  Synthetic polynucleotide
caggcggcggtgcggcggtg

SEQ ID NO: 4750 - DNA, 20 bp, Artificial Sequence
  Synthetic polynucleotide
tagcatgaagacggtgaaga

SEQ ID NO: 4751 - DNA, 20 bp, Artificial Sequence
  Synthetic polynucleotide
gcggcaggtgcggctgcagc

SEQ ID NO: 4752 - DNA, 20 bp, Artificial Sequence
  Synthetic polynucleotide
cactacatcacagaggctgt

SEQ ID NO: 4753 - DNA, 20 bp, Artificial Sequence
  Synthetic polynucleotide
gacgacgacgacgacaatga

SEQ ID NO: 4754 - DNA, 20 bp, Artificial Sequence
  Synthetic polynucleotide
cagtgaggaggaagaagagg

SEQ ID NO: 4755 - DNA, 20 bp, Artificial Sequence
  Synthetic polynucleotide
gacgtgggctgggccgggcc

SEQ ID NO: 4756 - DNA, 20 bp, Artificial Sequence
  Synthetic polynucleotide
tgcgcacggggtcccggccc

SEQ ID NO: 4757 - DNA, 20 bp, Artificial Sequence
  Synthetic polynucleotide
caccaatcccagttggtgct

SEQ ID NO: 4758 - DNA, 20 bp, Artificial Sequence
  Synthetic polynucleotide
tccgctcggcgcggcggcgg

SEQ ID NO: 4759 - DNA, 20 bp, Artificial Sequence
  Synthetic polynucleotide
atctaactgaagaggctttg

SEQ ID NO: 4760 - DNA, 20 bp, Artificial Sequence
  Synthetic polynucleotide
agcagcagcagcagcagcag

SEQ ID NO: 4761 - DNA, 20 bp, Artificial Sequence
  Synthetic polynucleotide
acggctgtggagctgacctg

SEQ ID NO: 4762 - DNA, 20 bp, Artificial Sequence
  Synthetic polynucleotide
ccagcgcagcgcagcgcagc

SEQ ID NO: 4763 - DNA, 20 bp, Artificial Sequence
  Synthetic polynucleotide
tggacgtagtcgccatgcca

SEQ ID NO: 4764 - DNA, 20 bp, Artificial Sequence
  Synthetic polynucleotide
ttggtgcatgaggatgcatg

SEQ ID NO: 4765 - DNA, 20 bp, Artificial Sequence
  Synthetic polynucleotide
tctaaaaattgctgaagtga

SEQ ID NO: 4766 - DNA, 20 bp, Artificial Sequence
  Synthetic polynucleotide
tcgtataagccaatgttggt

SEQ ID NO: 4767 - DNA, 20 bp, Artificial Sequence
  Synthetic polynucleotide
gcgaagatgcgaagatgcga

SEQ ID NO: 4768 - DNA, 20 bp, Artificial Sequence
  Synthetic polynucleotide
gcggcgggctcgggctgcgg

SEQ ID NO: 4769 - DNA, 20 bp, Artificial Sequence
  Synthetic polynucleotide
cagagctcaggcagaagctg

SEQ ID NO: 4770 - DNA, 20 bp, Artificial Sequence
  Synthetic polynucleotide
ggggcggggctgggctgggc

SEQ ID NO: 4771 - DNA, 20 bp, Artificial Sequence
  Synthetic polynucleotide
ccaggtgcacgatgcgtcgt

SEQ ID NO: 4772 - DNA, 20 bp, Artificial Sequence
  Synthetic polynucleotide
ccttgtgatgttagttagtt

SEQ ID NO: 4773 - DNA, 20 bp, Artificial Sequence
  Synthetic polynucleotide
tctctgcctgcaggatgagc

SEQ ID NO: 4774 - DNA, 20 bp, Artificial Sequence
  Synthetic polynucleotide
tccagaagaagctgaagggg

SEQ ID NO: 4775 - DNA, 20 bp, Artificial Sequence
  Synthetic polynucleotide
agaccaccagcagccgccta

SEQ ID NO: 4776 - DNA, 20 bp, Artificial Sequence
  Synthetic polynucleotide
gagtccagtgaaatggaaaa

SEQ ID NO: 4777 - DNA, 20 bp, Artificial Sequence
  Synthetic polynucleotide
ggcagtggtggcatgagggg

SEQ ID NO: 4778 - DNA, 20 bp, Artificial Sequence
  Synthetic polynucleotide
tctgaaggcaggtgcaaggc

SEQ ID NO: 4779 - DNA, 20 bp, Artificial Sequence
  Synthetic polynucleotide
gacatggctcacacggcaca

SEQ ID NO: 4780 - DNA, 20 bp, Artificial Sequence
  Synthetic polynucleotide
cggtggctgagctggatgga

SEQ ID NO: 4781 - DNA, 20 bp, Artificial Sequence
  Synthetic polynucleotide
tcccttaggaaaaaaagaca

SEQ ID NO: 4782 - DNA, 20 bp, Artificial Sequence
  Synthetic polynucleotide
tgcaaggacaaatctgactg

SEQ ID NO: 4783 - DNA, 20 bp, Artificial Sequence
  Synthetic polynucleotide
ctcaggaagaagagaagagc

SEQ ID NO: 4784 - DNA, 20 bp, Artificial Sequence
  Synthetic polynucleotide
cttcacctctccttttagga

SEQ ID NO: 4785 - DNA, 20 bp, Artificial Sequence
  Synthetic polynucleotide
gagcagcggcagaaaaacag

SEQ ID NO: 4786 - DNA, 20 bp, Artificial Sequence
  Synthetic polynucleotide
gggcagccgggcacgaaggt

SEQ ID NO: 4787 - DNA, 20 bp, Artificial Sequence
  Synthetic polynucleotide
accatgttcttcaggctggc

SEQ ID NO: 4788 - DNA, 20 bp, Artificial Sequence
  Synthetic polynucleotide
ctggggctgcgttgcagctg

SEQ ID NO: 4789 - DNA, 20 bp, Artificial Sequence
  Synthetic polynucleotide
actgtctgaagagctggagc

SEQ ID NO: 4790 - DNA, 20 bp, Artificial Sequence
  Synthetic polynucleotide
caggcctcgtgactttttgc

SEQ ID NO: 4791 - DNA, 20 bp, Artificial Sequence
  Synthetic polynucleotide
aagatcatacagacagagag

SEQ ID NO: 4792 - DNA, 20 bp, Artificial Sequence
  Synthetic polynucleotide
cgtgtgcaatacaggtggta

SEQ ID NO: 4793 - DNA, 20 bp, Artificial Sequence
  Synthetic polynucleotide
tttttccacttctggatcag

SEQ ID NO: 4794 - DNA, 20 bp, Artificial Sequence
  Synthetic polynucleotide
aaggggaaattgcacaagcc

SEQ ID NO: 4795 - DNA, 20 bp, Artificial Sequence
  Synthetic polynucleotide
cagcagaccagggccccacc

SEQ ID NO: 4796 - DNA, 20 bp, Artificial Sequence
  Synthetic polynucleotide
gaactcaaaacactggctgt

SEQ ID NO: 4797 - DNA, 20 bp, Artificial Sequence
  Synthetic polynucleotide
atgataccacaggattgggt

SEQ ID NO: 4798 - DNA, 20 bp, Artificial Sequence
  Synthetic polynucleotide
ggtttggttgtcagggcccc

SEQ ID NO: 4799 - DNA, 20 bp, Artificial Sequence
  Synthetic polynucleotide
cggccagccagccccggtac

SEQ ID NO: 4800 - DNA, 20 bp, Artificial Sequence
  Synthetic polynucleotide
gattcccatcaaacaaacag

SEQ ID NO: 4801 - DNA, 20 bp, Artificial Sequence
  Synthetic polynucleotide
ttgccaaagctgttagggtt

SEQ ID NO: 4802 - DNA, 20 bp, Artificial Sequence
  Synthetic polynucleotide
aaggttcttaaagatgatgt

SEQ ID NO: 4803 - DNA, 20 bp, Artificial Sequence
  Synthetic polynucleotide
tgggtttgaaggatgcgatg

SEQ ID NO: 4804 - DNA, 20 bp, Artificial Sequence
  Synthetic polynucleotide
gaatagcttctctatctatc

SEQ ID NO: 4805 - DNA, 20 bp, Artificial Sequence
  Synthetic polynucleotide
cacagaaacatgtacagtac

SEQ ID NO: 4806 - DNA, 20 bp, Artificial Sequence
  Synthetic polynucleotide
gcggggaactggcgcggcgc

SEQ ID NO: 4807 - DNA, 20 bp, Artificial Sequence
  Synthetic polynucleotide
catgccgtctgcaatctctc

SEQ ID NO: 4808 - DNA, 20 bp, Artificial Sequence
  Synthetic polynucleotide
tgtaacaatcttctctggcg

SEQ ID NO: 4809 - DNA, 20 bp, Artificial Sequence
  Synthetic polynucleotide
cccggggccgccgacccacc

SEQ ID NO: 4810 - DNA, 20 bp, Artificial Sequence
  Synthetic polynucleotide
cgaatctcatctcacctcac

SEQ ID NO: 4811 - DNA, 20 bp, Artificial Sequence
  Synthetic polynucleotide
tgccaggcacaaaacggttt

SEQ ID NO: 4812 - DNA, 20 bp, Artificial Sequence
  Synthetic polynucleotide
tttggaagatgagccacctt

SEQ ID NO: 4813 - DNA, 20 bp, Artificial Sequence
  Synthetic polynucleotide
cataagacttggacttgact

SEQ ID NO: 4814 - DNA, 20 bp, Artificial Sequence
  Synthetic polynucleotide
aaaaagcagatgacttgggt

SEQ ID NO: 4815 - DNA, 20 bp, Artificial Sequence
  Synthetic polynucleotide
aggctgctgcggccctgctg

SEQ ID NO: 4816 - DNA, 20 bp, Artificial Sequence
  Synthetic polynucleotide
ctgggatgctgggccccgct

SEQ ID NO: 4817 - DNA, 20 bp, Artificial Sequence
  Synthetic polynucleotide
tggagggtggaacgtggtgg

SEQ ID NO: 4818 - DNA, 20 bp, Artificial Sequence
  Synthetic polynucleotide
gctacgcggtggaggcaggg

SEQ ID NO: 4819 - DNA, 20 bp, Artificial Sequence
  Synthetic polynucleotide
tcccggccaccctggtcccc

SEQ ID NO: 4820 - DNA, 20 bp, Artificial Sequence
  Synthetic polynucleotide
ttcccctcaaaacatcattg

SEQ ID NO: 4821 - DNA, 20 bp, Artificial Sequence
  Synthetic polynucleotide
ggctggcagacggggccaga

SEQ ID NO: 4822 - DNA, 20 bp, Artificial Sequence
  Synthetic polynucleotide
aggtgggagaaggtgagaga

SEQ ID NO: 4823 - DNA, 20 bp, Artificial Sequence
  Synthetic polynucleotide
catctggacccttttccatc

SEQ ID NO: 4824 - DNA, 20 bp, Artificial Sequence
  Synthetic polynucleotide
aattttcttgttcatggcgg

SEQ ID NO: 4825 - DNA, 20 bp, Artificial Sequence
  Synthetic polynucleotide
tataccctgatagagtcggt

SEQ ID NO: 4826 - DNA, 20 bp, Artificial Sequence
  Synthetic polynucleotide
aacactggctgtttcatgca

SEQ ID NO: 4827 - DNA, 20 bp, Artificial Sequence
  Synthetic polynucleotide
cggtggggcaggcggcggtg

SEQ ID NO: 4828 - DNA, 20 bp, Artificial Sequence
  Synthetic polynucleotide
ggtgtggaaggagtcgccgc

SEQ ID NO: 4829 - DNA, 20 bp, Artificial Sequence
  Synthetic polynucleotide
ctgcaggacaacggcaggac

SEQ ID NO: 4830 - DNA, 20 bp, Artificial Sequence
  Synthetic polynucleotide
ggggcggcggcggcggccgg

SEQ ID NO: 4831 - DNA, 20 bp, Artificial Sequence
  Synthetic polynucleotide
gagggcgatggcgaaggcga

SEQ ID NO: 4832 - DNA, 20 bp, Artificial Sequence
  Synthetic polynucleotide
cgctcccggtgccccgctcc

SEQ ID NO: 4833 - DNA, 20 bp, Artificial Sequence
  Synthetic polynucleotide
ttccgggctaaagaagcccc

SEQ ID NO: 4834 - DNA, 20 bp, Artificial Sequence
  Synthetic polynucleotide
gccatcatcatcatcatcag

SEQ ID NO: 4835 - DNA, 20 bp, Artificial Sequence
  Synthetic polynucleotide
tagtggccatgcacgtcacg

SEQ ID NO: 4836 - DNA, 20 bp, Artificial Sequence
  Synthetic polynucleotide
gcgtggtaaacttttgggcg

SEQ ID NO: 4837 - DNA, 20 bp, Artificial Sequence
  Synthetic polynucleotide
ggttctttgagcaaccaaca

SEQ ID NO: 4838 - DNA, 20 bp, Artificial Sequence
  Synthetic polynucleotide
gcaccaggaactcggcttct

SEQ ID NO: 4839 - DNA, 20 bp, Artificial Sequence
  Synthetic polynucleotide
gcgtgaacctggagggtggg

SEQ ID NO: 4840 - DNA, 20 bp, Artificial Sequence
  Synthetic polynucleotide
acccactggacactggacac

SEQ ID NO: 4841 - DNA, 20 bp, Artificial Sequence
  Synthetic polynucleotide
ccaggaagtcttggaagtct

SEQ ID NO: 4842 - DNA, 20 bp, Artificial Sequence
  Synthetic polynucleotide
cagtggctgggctgcgggtc

SEQ ID NO: 4843 - DNA, 20 bp, Artificial Sequence
  Synthetic polynucleotide
gttgcgcagccaccggacac

SEQ ID NO: 4844 - DNA, 20 bp, Artificial Sequence
  Synthetic polynucleotide
ctcgctggctgcagggctgc

SEQ ID NO: 4845 - DNA, 20 bp, Artificial Sequence
  Synthetic polynucleotide
gccttctaccggaaagatga

SEQ ID NO: 4846 - DNA, 20 bp, Artificial Sequence
  Synthetic polynucleotide
cgacggcagctctccgacga

SEQ ID NO: 4847 - DNA, 20 bp, Artificial Sequence
  Synthetic polynucleotide
tggaggcctgcgggaagctt

SEQ ID NO: 4848 - DNA, 20 bp, Artificial Sequence
  Synthetic polynucleotide
ggtcggcgtggaggcggcgg

SEQ ID NO: 4849 - DNA, 20 bp, Artificial Sequence
  Synthetic polynucleotide
gaagcctctgggctcgggct

SEQ ID NO: 4850 - DNA, 20 bp, Artificial Sequence
  Synthetic polynucleotide
tcacccctggatatatgtat

SEQ ID NO: 4851 - DNA, 20 bp, Artificial Sequence
  Synthetic polynucleotide
tgctgagcagtgtggaagtg

SEQ ID NO: 4852 - DNA, 20 bp, Artificial Sequence
  Synthetic polynucleotide
ttggatacagagcagggagc

SEQ ID NO: 4853 - DNA, 20 bp, Artificial Sequence
  Synthetic polynucleotide
gtggccctgcccggcgcgtg

SEQ ID NO: 4854 - DNA, 20 bp, Artificial Sequence
  Synthetic polynucleotide
tttcaagcttttgatgaatg

SEQ ID NO: 4855 - DNA, 20 bp, Artificial Sequence
  Synthetic polynucleotide
agctggacttgctcaggagc

SEQ ID NO: 4856 - DNA, 20 bp, Artificial Sequence
  Synthetic polynucleotide
aggcgggtcgggggcggggc

SEQ ID NO: 4857 - DNA, 20 bp, Artificial Sequence
  Synthetic polynucleotide
gtagtgattggctgattgat

SEQ ID NO: 4858 - DNA, 20 bp, Artificial Sequence
  Synthetic polynucleotide
acgccggcatctcaggccgc

SEQ ID NO: 4859 - DNA, 20 bp, Artificial Sequence
  Synthetic polynucleotide
cttggacaccgtcaggtgtc

SEQ ID NO: 4860 - DNA, 20 bp, Artificial Sequence
  Synthetic polynucleotide
acggctcctcggcctcgcct

SEQ ID NO: 4861 - DNA, 20 bp, Artificial Sequence
  Synthetic polynucleotide
agagtggaaggccaggcagg

SEQ ID NO: 4862 - DNA, 20 bp, Artificial Sequence
  Synthetic polynucleotide
gccgggagacggggctgctg

SEQ ID NO: 4863 - DNA, 20 bp, Artificial Sequence
  Synthetic polynucleotide
ggccttccgctacagacaga

SEQ ID NO: 4864 - DNA, 20 bp, Artificial Sequence
  Synthetic polynucleotide
cccgaggtccgctgctcccg

SEQ ID NO: 4865 - DNA, 20 bp, Artificial Sequence
  Synthetic polynucleotide
tctgcagctgcagctgcagc

SEQ ID NO: 4866 - DNA, 20 bp, Artificial Sequence
  Synthetic polynucleotide
catttgtggcaaaacatttg

SEQ ID NO: 4867 - DNA, 20 bp, Artificial Sequence
  Synthetic polynucleotide
gttggcaccaggcacggacg

SEQ ID NO: 4868 - DNA, 20 bp, Artificial Sequence
  Synthetic polynucleotide
cctggtccccctggtccccc

SEQ ID NO: 4869 - DNA, 20 bp, Artificial Sequence
  Synthetic polynucleotide
gaatgcgcgaagcagggcgt

SEQ ID NO: 4870 - DNA, 20 bp, Artificial Sequence
  Synthetic polynucleotide
gtcacagacacagatccatc

SEQ ID NO: 4871 - DNA, 20 bp, Artificial Sequence
  Synthetic polynucleotide
gtctccagccttgtctgtct

SEQ ID NO: 4872 - DNA, 20 bp, Artificial Sequence
  Synthetic polynucleotide
gacgcgctctcgtaggtggt

SEQ ID NO: 4873 - DNA, 20 bp, Artificial Sequence
  Synthetic polynucleotide
ggagccatccagcaggaagc

SEQ ID NO: 4874 - DNA, 20 bp, Artificial Sequence
  Synthetic polynucleotide
atgtatatgcaactggttgg

SEQ ID NO: 4875 - DNA, 20 bp, Artificial Sequence
  Synthetic polynucleotide
ataaacatacggaggagtcg

SEQ ID NO: 4876 - DNA, 20 bp, Artificial Sequence
  Synthetic polynucleotide
cacctggatgagacggtccc

SEQ ID NO: 4877 - DNA, 20 bp, Artificial Sequence
  Synthetic polynucleotide
ctgttccaggtagtggtgat

SEQ ID NO: 4878 - DNA, 20 bp, Artificial Sequence
  Synthetic polynucleotide
tttttccatataagataaga

SEQ ID NO: 4879 - DNA, 20 bp, Artificial Sequence
  Synthetic polynucleotide
tgctggcacctgagccgtgc

SEQ ID NO: 4880 - DNA, 20 bp, Artificial Sequence
  Synthetic polynucleotide
gtgggagcaggaggcctgcc

SEQ ID NO: 4881 - DNA, 20 bp, Artificial Sequence
  Synthetic polynucleotide
ggtgcggcgggaggaggcgg

SEQ ID NO: 4882 - DNA, 20 bp, Artificial Sequence
  Synthetic polynucleotide
tcttggacggcggccggccg

SEQ ID NO: 4883 - DNA, 20 bp, Artificial Sequence
  Synthetic polynucleotide
gcacgcggtgctggctctgc

SEQ ID NO: 4884 - DNA, 20 bp, Artificial Sequence
  Synthetic polynucleotide
aagggcagtggtgagcaagc

SEQ ID NO: 4885 - DNA, 20 bp, Artificial Sequence
  Synthetic polynucleotide
gtgatccggagatcggagat

SEQ ID NO: 4886 - DNA, 20 bp, Artificial Sequence
  Synthetic polynucleotide
tatgtcaactggattgatta

SEQ ID NO: 4887 - DNA, 20 bp, Artificial Sequence
  Synthetic polynucleotide
gacgagactatctggctggc

SEQ ID NO: 4888 - DNA, 20 bp, Artificial Sequence
  Synthetic polynucleotide
tatagagtgtggtataaatg

SEQ ID NO: 4889 - DNA, 20 bp, Artificial Sequence
  Synthetic polynucleotide
gcacgaagacatcgataata

SEQ ID NO: 4890 - DNA, 20 bp, Artificial Sequence
  Synthetic polynucleotide
cagaaaaagtagaaaaaaaa

SEQ ID NO: 4891 - DNA, 20 bp, Artificial Sequence
  Synthetic polynucleotide
aatggatcttacagggttac

SEQ ID NO: 4892 - DNA, 20 bp, Artificial Sequence
  Synthetic polynucleotide
cgcgggcggcgcgggcggcg

SEQ ID NO: 4893 - DNA, 20 bp, Artificial Sequence
  Synthetic polynucleotide
ggtagcagcagcagcagcag

SEQ ID NO: 4894 - DNA, 20 bp, Artificial Sequence
  Synthetic polynucleotide
ttcaggatgagactggagac

SEQ ID NO: 4895 - DNA, 20 bp, Artificial Sequence
  Synthetic polynucleotide
tcagactcaggatggatgga

SEQ ID NO: 4896 - DNA, 20 bp, Artificial Sequence
  Synthetic polynucleotide
agaggcgctaccaggcgggc

SEQ ID NO: 4897 - DNA, 20 bp, Artificial Sequence
  Synthetic polynucleotide
agaagcagaagatagaagat

SEQ ID NO: 4898 - DNA, 20 bp, Artificial Sequence
  Synthetic polynucleotide
tctcatggatgagacgctca

SEQ ID NO: 4899 - DNA, 20 bp, Artificial Sequence
  Synthetic polynucleotide
tctttggctatgaaggttga

SEQ ID NO: 4900 - DNA, 20 bp, Artificial Sequence
  Synthetic polynucleotide
agcatctggaacaacagaac

SEQ ID NO: 4901 - DNA, 20 bp, Artificial Sequence
  Synthetic polynucleotide
cctgctggacctcactcgct

SEQ ID NO: 4902 - DNA, 20 bp, Artificial Sequence
  Synthetic polynucleotide
tcttctcatcatcatcatcg

SEQ ID NO: 4903 - DNA, 20 bp, Artificial Sequence
  Synthetic polynucleotide
ctttgtgttccagcagcaca

SEQ ID NO: 4904 - DNA, 20 bp, Artificial Sequence
  Synthetic polynucleotide
tctgtggaagtgctcagcat

SEQ ID NO: 4905 - DNA, 20 bp, Artificial Sequence
  Synthetic polynucleotide
gatttcctggagaaaggggg

SEQ ID NO: 4906 - DNA, 20 bp, Artificial Sequence
  Synthetic polynucleotide
tattttacttagacatgaca

SEQ ID NO: 4907 - DNA, 20 bp, Artificial Sequence
  Synthetic polynucleotide
cggaaggccacgactccccc

SEQ ID NO: 4908 - DNA, 20 bp, Artificial Sequence
  Synthetic polynucleotide
aagatgacgctggaccggac

SEQ ID NO: 4909 - DNA, 20 bp, Artificial Sequence
  Synthetic polynucleotide
atgaagactgacaggatgga

SEQ ID NO: 4910 - DNA, 20 bp, Artificial Sequence
  Synthetic polynucleotide
gcagcctggctgccgcagcc

SEQ ID NO: 4911 - DNA, 20 bp, Artificial Sequence
  Synthetic polynucleotide
aagacagcacacaaaaaaaa

SEQ ID NO: 4912 - DNA, 20 bp, Artificial Sequence
  Synthetic polynucleotide
ggctggtccattcccggggc

SEQ ID NO: 4913 - DNA, 20 bp, Artificial Sequence
  Synthetic polynucleotide
ccttcagcagccttcggtgc

SEQ ID NO: 4914 - DNA, 20 bp, Artificial Sequence
  Synthetic polynucleotide
cgaatgctataatgagtagt

SEQ ID NO: 4915 - DNA, 20 bp, Artificial Sequence
  Synthetic polynucleotide
tctccagcccgggtcggcgg

SEQ ID NO: 4916 - DNA, 20 bp, Artificial Sequence
  Synthetic polynucleotide
ctcaaggaacaatcaatcag

SEQ ID NO: 4917 - DNA, 20 bp, Artificial Sequence
  Synthetic polynucleotide
acgctgaagcagaacacaca

SEQ ID NO: 4918 - DNA, 20 bp, Artificial Sequence
  Synthetic polynucleotide
taggtccaggtgctgggtcc

SEQ ID NO: 4919 - DNA, 20 bp, Artificial Sequence
  Synthetic polynucleotide
gggtggcgggctgggccacc

SEQ ID NO: 4920 - DNA, 20 bp, Artificial Sequence
  Synthetic polynucleotide
actgacacctcagggacaaa

SEQ ID NO: 4921 - DNA, 20 bp, Artificial Sequence
  Synthetic polynucleotide
aggacaaatctgacactgca

SEQ ID NO: 4922 - DNA, 20 bp, Artificial Sequence
  Synthetic polynucleotide
atatggtgctctttaaaaca

SEQ ID NO: 4923 - DNA, 20 bp, Artificial Sequence
  Synthetic polynucleotide
aagggcgcactgctgctgct

SEQ ID NO: 4924 - DNA, 20 bp, Artificial Sequence
  Synthetic polynucleotide
gctgcccgcgctgctgctgc

SEQ ID NO: 4925 - DNA, 20 bp, Artificial Sequence
  Synthetic polynucleotide
tggtggatgtggcggagagg

SEQ ID NO: 4926 - DNA, 20 bp, Artificial Sequence
  Synthetic polynucleotide
atccaagtaagagaagtaag

SEQ ID NO: 4927 - DNA, 20 bp, Artificial Sequence
  Synthetic polynucleotide
gtcggcggccccggggcgac

SEQ ID NO: 4928 - DNA, 20 bp, Artificial Sequence
  Synthetic polynucleotide
attggaggcctgactcactc

SEQ ID NO: 4929 - DNA, 20 bp, Artificial Sequence
  Synthetic polynucleotide
gggggcatctatgtctgcgg

SEQ ID NO: 4930 - DNA, 20 bp, Artificial Sequence
  Synthetic polynucleotide
gaactcggcggggaggtgct

SEQ ID NO: 4931 - DNA, 20 bp, Artificial Sequence
  Synthetic polynucleotide
tcagtggatcaagtttacag

SEQ ID NO: 4932 - DNA, 20 bp, Artificial Sequence
  Synthetic polynucleotide
gttatggataaatatgaata

SEQ ID NO: 4933 - DNA, 20 bp, Artificial Sequence
  Synthetic polynucleotide
tgtttttgctgtaggttttg

SEQ ID NO: 4934 - DNA, 20 bp, Artificial Sequence
  Synthetic polynucleotide
cgcggcgctggacgacggcg

SEQ ID NO: 4935 - DNA, 20 bp, Artificial Sequence
  Synthetic polynucleotide
cctggtgctgtaggtgctca

SEQ ID NO: 4936 - DNA, 20 bp, Artificial Sequence
  Synthetic polynucleotide
gaaagggccttcctgaggaa

SEQ ID NO: 4937 - DNA, 20 bp, Artificial Sequence
  Synthetic polynucleotide
tgaccgccttactgaaatga

SEQ ID NO: 4938 - DNA, 20 bp, Artificial Sequence
  Synthetic polynucleotide
atgatgaagcggcccagaag

SEQ ID NO: 4939 - DNA, 20 bp, Artificial Sequence
  Synthetic polynucleotide
ttggacagcagattcacgaa

SEQ ID NO: 4940 - DNA, 20 bp, Artificial Sequence
  Synthetic polynucleotide
ctgcgctgtggacactgctg

SEQ ID NO: 4941 - DNA, 20 bp, Artificial Sequence
  Synthetic polynucleotide
gacggcgacggtgtagtgga

SEQ ID NO: 4942 - DNA, 20 bp, Artificial Sequence
  Synthetic polynucleotide
agcgatcaggatgaccacca

SEQ ID NO: 4943 - DNA, 20 bp, Artificial Sequence
  Synthetic polynucleotide
gacagcggagtggagctggc

SEQ ID NO: 4944 - DNA, 20 bp, Artificial Sequence
  Synthetic polynucleotide
tacctggtgcgggaggaggg

SEQ ID NO: 4945 - DNA, 20 bp, Artificial Sequence
  Synthetic polynucleotide
gcaggctgacgagtgcctgc

SEQ ID NO: 4946 - DNA, 20 bp, Artificial Sequence
  Synthetic polynucleotide
cggcggtggctgctggatac

SEQ ID NO: 4947 - DNA, 20 bp, Artificial Sequence
  Synthetic polynucleotide
gatcttgtcctgatggaaaa

SEQ ID NO: 4948 - DNA, 20 bp, Artificial Sequence
  Synthetic polynucleotide
ctaacatcacaaggtgatca

SEQ ID NO: 4949 - DNA, 20 bp, Artificial Sequence
  Synthetic polynucleotide
ttgctactctcagaaagaaa

SEQ ID NO: 4950 - DNA, 20 bp, Artificial Sequence
  Synthetic polynucleotide
cctgtgcaccatgtgtaggt

SEQ ID NO: 4951 - DNA, 20 bp, Artificial Sequence
  Synthetic polynucleotide
actttaggcagaggctgggc

SEQ ID NO: 4952 - DNA, 20 bp, Artificial Sequence
  Synthetic polynucleotide
attttggctttctgtatgta

SEQ ID NO: 4953 - DNA, 20 bp, Artificial Sequence
  Synthetic polynucleotide
cgtggccgacctgtctatcg

SEQ ID NO: 4954 - DNA, 20 bp, Artificial Sequence
  Synthetic polynucleotide
tgtgatgaagctgaaggaag

SEQ ID NO: 4955 - DNA, 20 bp, Artificial Sequence
  Synthetic polynucleotide
aaaaatcgttttagggtttt

SEQ ID NO: 4956 - DNA, 20 bp, Artificial Sequence
  Synthetic polynucleotide
caagaccgaacactacttac

SEQ ID NO: 4957 - DNA, 20 bp, Artificial Sequence
  Synthetic polynucleotide
ggaggtggaggtggaggtgg

SEQ ID NO: 4958 - DNA, 20 bp, Artificial Sequence
  Synthetic polynucleotide
agcccagcgcgcaggagcag

SEQ ID NO: 4959 - DNA, 20 bp, Artificial Sequence
  Synthetic polynucleotide
ccagggggtccttgaatgaa

SEQ ID NO: 4960 - DNA, 20 bp, Artificial Sequence
  Synthetic polynucleotide
gagaggctgccggacaggac

SEQ ID NO: 4961 - DNA, 20 bp, Artificial Sequence
  Synthetic polynucleotide
ggctgccttcgggccgcctt

SEQ ID NO: 4962 - DNA, 20 bp, Artificial Sequence
  Synthetic polynucleotide
ggcggcggcggcggcagcag

SEQ ID NO: 4963 - DNA, 20 bp, Artificial Sequence
  Synthetic polynucleotide
cccgactgcaaggacaaatc

SEQ ID NO: 4964 - DNA, 20 bp, Artificial Sequence
  Synthetic polynucleotide
ggaggaggaggaggaggagg

SEQ ID NO: 4965 - DNA, 20 bp, Artificial Sequence
  Synthetic polynucleotide
ggcggcggggctggcgcggc

SEQ ID NO: 4966 - DNA, 20 bp, Artificial Sequence
  Synthetic polynucleotide
gctcagcatctgtcagtcag

SEQ ID NO: 4967 - DNA, 20 bp, Artificial Sequence
  Synthetic polynucleotide
ctttcggcaaggcttcgacg

SEQ ID NO: 4968 - DNA, 20 bp, Artificial Sequence
  Synthetic polynucleotide
tgcccctactgcgaccgacc

SEQ ID NO: 4969 - DNA, 20 bp, Artificial Sequence
  Synthetic polynucleotide
gaggctgttctcaggatggt

SEQ ID NO: 4970 - DNA, 20 bp, Artificial Sequence
  Synthetic polynucleotide
aaggtgatctcgcagctagc

SEQ ID NO: 4971 - DNA, 20 bp, Artificial Sequence
  Synthetic polynucleotide
ccggacggcatgctgcttgc

SEQ ID NO: 4972 - DNA, 20 bp, Artificial Sequence
  Synthetic polynucleotide
gcgggaccagcaggaccagc

SEQ ID NO: 4973 - DNA, 20 bp, Artificial Sequence
  Synthetic polynucleotide
ccatttcctgtaagcaagcc

SEQ ID NO: 4974 - DNA, 20 bp, Artificial Sequence
  Synthetic polynucleotide
ggaactgtgcgctggtgcgc

SEQ ID NO: 4975 - DNA, 20 bp, Artificial Sequence
  Synthetic polynucleotide
tcatcgtacctctcgggtcc

SEQ ID NO: 4976 - DNA, 20 bp, Artificial Sequence
  Synthetic polynucleotide
gaatttctggatttgcgggc

SEQ ID NO: 4977 - DNA, 20 bp, Artificial Sequence
  Synthetic polynucleotide
attttatgggctaggtcggt

SEQ ID NO: 4978 - DNA, 20 bp, Artificial Sequence
  Synthetic polynucleotide
taaaaggtataaaattttta

SEQ ID NO: 4979 - DNA, 20 bp, Artificial Sequence
  Synthetic polynucleotide
tgtgccacatggctcccaca

SEQ ID NO: 4980 - DNA, 20 bp, Artificial Sequence
  Synthetic polynucleotide
tttggcaggagctgctgggc

SEQ ID NO: 4981 - DNA, 20 bp, Artificial Sequence
  Synthetic polynucleotide
agcgctgggctgtgggcagt

SEQ ID NO: 4982 - DNA, 20 bp, Artificial Sequence
  Synthetic polynucleotide
aactcaggttcggttttaat

SEQ ID NO: 4983 - DNA, 20 bp, Artificial Sequence
  Synthetic polynucleotide
gccatgtacagcgagcgagc

SEQ ID NO: 4984 - DNA, 20 bp, Artificial Sequence
  Synthetic polynucleotide
gctgggccttccatttagct

SEQ ID NO: 4985 - DNA, 20 bp, Artificial Sequence
  Synthetic polynucleotide
gacacaggcgtcgctgacac

SEQ ID NO: 4986 - DNA, 20 bp, Artificial Sequence
  Synthetic polynucleotide
ctttgtggtggacatgatga

SEQ ID NO: 4987 - DNA, 20 bp, Artificial Sequence
  Synthetic polynucleotide
ggccctggtctcggcggcgg

SEQ ID NO: 4988 - DNA, 20 bp, Artificial Sequence
  Synthetic polynucleotide
aagggggcggaggcctggca

SEQ ID NO: 4989 - DNA, 20 bp, Artificial Sequence
  Synthetic polynucleotide
tgccctgcctgtgaggggag

SEQ ID NO: 4990 - DNA, 20 bp, Artificial Sequence
  Synthetic polynucleotide
gcagggtcagcctggaggcc

SEQ ID NO: 4991 - DNA, 20 bp, Artificial Sequence
  Synthetic polynucleotide
cggccctggacgtgggtacg

SEQ ID NO: 4992 - DNA, 20 bp, Artificial Sequence
  Synthetic polynucleotide
ctacatcccgcagagcgcag

SEQ ID NO: 4993 - DNA, 20 bp, Artificial Sequence
  Synthetic polynucleotide
agcggtgcatgggctgcgca

SEQ ID NO: 4994 - DNA, 20 bp, Artificial Sequence
  Synthetic polynucleotide
tggggccgggccgggccggc

SEQ ID NO: 4995 - DNA, 20 bp, Artificial Sequence
  Synthetic polynucleotide
tgggagcagcaggtgtcgat

SEQ ID NO: 4996 - DNA, 20 bp, Artificial Sequence
  Synthetic polynucleotide
gcattgcagtgacggatgga

SEQ ID NO: 4997 - DNA, 20 bp, Artificial Sequence
  Synthetic polynucleotide
ccacgctggtgctgcagggc

SEQ ID NO: 4998 - DNA, 20 bp, Artificial Sequence
  Synthetic polynucleotide
cagtcgcagtagtagctggc

SEQ ID NO: 4999 - DNA, 20 bp, Artificial Sequence
  Synthetic polynucleotide
gctgctccaggaagtcggct

SEQ ID NO: 5000 - DNA, 20 bp, Artificial Sequence
  Synthetic polynucleotide
tgaacttacagatgggtggg

SEQ ID NO: 5001 - DNA, 20 bp, Artificial Sequence
  Synthetic polynucleotide
gtgacaggaggaacggagga

SEQ ID NO: 5002 - DNA, 20 bp, Artificial Sequence
  Synthetic polynucleotide
gcaacttgacaataaaagaa

SEQ ID NO: 5003 - DNA, 20 bp, Artificial Sequence
  Synthetic polynucleotide
tgcggtccgggactgcggtc

SEQ ID NO: 5004 - DNA, 20 bp, Artificial Sequence
  Synthetic polynucleotide
caatgaacttacgcttggta

SEQ ID NO: 5005 - DNA, 20 bp, Artificial Sequence
  Synthetic polynucleotide
gcaggagactactggactac

SEQ ID NO: 5006 - DNA, 20 bp, Artificial Sequence
  Synthetic polynucleotide
ggtcggcgggcgcagccggt

SEQ ID NO: 5007 - DNA, 20 bp, Artificial Sequence
  Synthetic polynucleotide
tttttgtttcctttataata

SEQ ID NO: 5008 - DNA, 20 bp, Artificial Sequence
  Synthetic polynucleotide
cagaaagggatggcgcggcg

SEQ ID NO: 5009 - DNA, 20 bp, Artificial Sequence
  Synthetic polynucleotide
tgttgggctttagcattagc

SEQ ID NO: 5010 - DNA, 20 bp, Artificial Sequence
  Synthetic polynucleotide
gggcttgatgagtggtcggt

SEQ ID NO: 5011 - DNA, 20 bp, Artificial Sequence
  Synthetic polynucleotide
tctggtcctgttggtcctgt

SEQ ID NO: 5012 - DNA, 20 bp, Artificial Sequence
  Synthetic polynucleotide
gcgccgccaggtgcgggtgc

SEQ ID NO: 5013 - DNA, 20 bp, Artificial Sequence
  Synthetic polynucleotide
cgaaagccggggagtgagtg

SEQ ID NO: 5014 - DNA, 20 bp, Artificial Sequence
  Synthetic polynucleotide
tggcactcttacttacttac

SEQ ID NO: 5015 - DNA, 20 bp, Artificial Sequence
  Synthetic polynucleotide
agtcctgctgatgctagcta

SEQ ID NO: 5016 - DNA, 20 bp, Artificial Sequence
  Synthetic polynucleotide
ggcgaggagctgggaggagc

SEQ ID NO: 5017 - DNA, 20 bp, Artificial Sequence
  Synthetic polynucleotide
aattggggacatgggcttcg

SEQ ID NO: 5018 - DNA, 20 bp, Artificial Sequence
  Synthetic polynucleotide
acctcctccagccagccagc

SEQ ID NO: 5019 - DNA, 20 bp, Artificial Sequence
  Synthetic polynucleotide
cggaatactggttgtttgtt

SEQ ID NO: 5020 - DNA, 20 bp, Artificial Sequence
  Synthetic polynucleotide
caggccttcgaggaggtcta

SEQ ID NO: 5021 - DNA, 20 bp, Artificial Sequence
  Synthetic polynucleotide
aagtggcggccgattgttgt

SEQ ID NO: 5022 - DNA, 20 bp, Artificial Sequence
  Synthetic polynucleotide
cacccagcgagagggccgag

SEQ ID NO: 5023 - DNA, 20 bp, Artificial Sequence
  Synthetic polynucleotide
tgtgaaagatgggtccggtc

SEQ ID NO: 5024 - DNA, 20 bp, Artificial Sequence
  Synthetic polynucleotide
aatgtcaaaacggagctgaa

SEQ ID NO: 5025 - DNA, 20 bp, Artificial Sequence
  Synthetic polynucleotide
gaagagggagagggaggcga

SEQ ID NO: 5026 - DNA, 20 bp, Artificial Sequence
  Synthetic polynucleotide
aggcggtcggcgggcgcggt

SEQ ID NO: 5027 - DNA, 20 bp, Artificial Sequence
  Synthetic polynucleotide
ctgggctgtttctgtggtga

SEQ ID NO: 5028 - DNA, 20 bp, Artificial Sequence
  Synthetic polynucleotide
ccttcttgctgacgtgctga

SEQ ID NO: 5029 - DNA, 20 bp, Artificial Sequence
  Synthetic polynucleotide
cccagccagcagcagcaggc

SEQ ID NO: 5030 - DNA, 20 bp, Artificial Sequence
  Synthetic polynucleotide
ggctcataccgcgtgtggtg

SEQ ID NO: 5031 - DNA, 20 bp, Artificial Sequence
  Synthetic polynucleotide
tacatttgcttgggagtcat

SEQ ID NO: 5032 - DNA, 20 bp, Artificial Sequence
  Synthetic polynucleotide
ccagttccagaagggcaata

SEQ ID NO: 5033 - DNA, 20 bp, Artificial Sequence
  Synthetic polynucleotide
cccgggaaggggcatgggaa

SEQ ID NO: 5034 - DNA, 20 bp, Artificial Sequence
  Synthetic polynucleotide
gggcatggctctctggggca

SEQ ID NO: 5035 - DNA, 20 bp, Artificial Sequence
  Synthetic polynucleotide
ccaggaggtgaggttgcagg

SEQ ID NO: 5036 - DNA, 20 bp, Artificial Sequence
  Synthetic polynucleotide
caagcagtgaggaatcagtg

SEQ ID NO: 5037 - DNA, 20 bp, Artificial Sequence
  Synthetic polynucleotide
tggctctgtggctggctctg

SEQ ID NO: 5038 - DNA, 20 bp, Artificial Sequence
  Synthetic polynucleotide
cgccccttggggccaccctg

SEQ ID NO: 5039 - DNA, 20 bp, Artificial Sequence
  Synthetic polynucleotide
gtcgccccctgggctcacct

SEQ ID NO: 5040 - DNA, 20 bp, Artificial Sequence
  Synthetic polynucleotide
gcgctgctgctgctgcttgc

SEQ ID NO: 5041 - DNA, 20 bp, Artificial Sequence
  Synthetic polynucleotide
ctcctacagggtaataatgt

SEQ ID NO: 5042 - DNA, 20 bp, Artificial Sequence
  Synthetic polynucleotide
gtccgcctctggtccgcctc

SEQ ID NO: 5043 - DNA, 20 bp, Artificial Sequence
  Synthetic polynucleotide
gctgtagtcgtgggcagtcg

SEQ ID NO: 5044 - DNA, 20 bp, Artificial Sequence
  Synthetic polynucleotide
tcaggagagcacgagagatc

SEQ ID NO: 5045 - DNA, 20 bp, Artificial Sequence
  Synthetic polynucleotide
atatccctcagtacaggagc

SEQ ID NO: 5046 - DNA, 20 bp, Artificial Sequence
  Synthetic polynucleotide
caacatggcagcagccaaca

SEQ ID NO: 5047 - DNA, 20 bp, Artificial Sequence
  Synthetic polynucleotide
cagctggagtggatgccagc

SEQ ID NO: 5048 - DNA, 20 bp, Artificial Sequence
  Synthetic polynucleotide
tgctgcagatccgtgggcgt

SEQ ID NO: 5049 - DNA, 20 bp, Artificial Sequence
  Synthetic polynucleotide
catgggcatgcagggcatgc

SEQ ID NO: 5050 - DNA, 20 bp, Artificial Sequence
  Synthetic polynucleotide
caactgctaaagcaagaaag

SEQ ID NO: 5051 - DNA, 20 bp, Artificial Sequence
  Synthetic polynucleotide
ccctacgtggagcccaacac

SEQ ID NO: 5052 - DNA, 20 bp, Artificial Sequence
  Synthetic polynucleotide
ctcgctcattcactccctcc

SEQ ID NO: 5053 - DNA, 20 bp, Artificial Sequence
  Synthetic polynucleotide
ccacccacctggcggtgggg

SEQ ID NO: 5054 - DNA, 20 bp, Artificial Sequence
  Synthetic polynucleotide
gcctcgatgtcgtcggccgt

SEQ ID NO: 5055 - DNA, 20 bp, Artificial Sequence
  Synthetic polynucleotide
gcatgcccagctggtccagc

SEQ ID NO: 5056 - DNA, 20 bp, Artificial Sequence
  Synthetic polynucleotide
tgcgcataggcctgggccct

SEQ ID NO: 5057 - DNA, 20 bp, Artificial Sequence
  Synthetic polynucleotide
tggccctacctgaaggctga

SEQ ID NO: 5058 - DNA, 20 bp, Artificial Sequence
  Synthetic polynucleotide
cccatgggtgggctatatat

SEQ ID NO: 5059 - DNA, 20 bp, Artificial Sequence
  Synthetic polynucleotide
aggcacgagcggcgcacgag

SEQ ID NO: 5060 - DNA, 20 bp, Artificial Sequence
  Synthetic polynucleotide
aagatcaagtttttggtttt

SEQ ID NO: 5061 - DNA, 20 bp, Artificial Sequence
  Synthetic polynucleotide
agcagcagcggcagcagcag

SEQ ID NO: 5062 - DNA, 20 bp, Artificial Sequence
  Synthetic polynucleotide
tcttgtattctaattccctt

SEQ ID NO: 5063 - DNA, 20 bp, Artificial Sequence
  Synthetic polynucleotide
gcgttcgcaggacgggcgac

SEQ ID NO: 5064 - DNA, 20 bp, Artificial Sequence
  Synthetic polynucleotide
aggaatatgactatatgact

SEQ ID NO: 5065 - DNA, 20 bp, Artificial Sequence
  Synthetic polynucleotide
gatctcaacagaaggtggtg

SEQ ID NO: 5066 - DNA, 20 bp, Artificial Sequence
  Synthetic polynucleotide
aggcaccggggtggtggtgg

SEQ ID NO: 5067 - DNA, 20 bp, Artificial Sequence
  Synthetic polynucleotide
tagagtgtcccatctgcatc

SEQ ID NO: 5068 - DNA, 20 bp, Artificial Sequence
  Synthetic polynucleotide
ctgcaaggacaaatctgaca

SEQ ID NO: 5069 - DNA, 20 bp, Artificial Sequence
  Synthetic polynucleotide
ccgccactcgagcgtgcgtg

SEQ ID NO: 5070 - DNA, 20 bp, Artificial Sequence
  Synthetic polynucleotide
ttccacaccttcgctggaga

SEQ ID NO: 5071 - DNA, 20 bp, Artificial Sequence
  Synthetic polynucleotide
gacctcttccagtgggccgt

SEQ ID NO: 5072 - DNA, 20 bp, Artificial Sequence
  Synthetic polynucleotide
tcgaaggtctcgatggatgt

SEQ ID NO: 5073 - DNA, 20 bp, Artificial Sequence
  Synthetic polynucleotide
aggtcctgggcagaaggacc

SEQ ID NO: 5074 - DNA, 20 bp, Artificial Sequence
  Synthetic polynucleotide
aggtcgcggcagtggctggc

SEQ ID NO: 5075 - DNA, 20 bp, Artificial Sequence
  Synthetic polynucleotide
gaccatctacatagccagcc

SEQ ID NO: 5076 - DNA, 20 bp, Artificial Sequence
  Synthetic polynucleotide
gagtgaaacagggatctatc

SEQ ID NO: 5077 - DNA, 20 bp, Artificial Sequence
  Synthetic polynucleotide
agcggctggcggctggcggc

SEQ ID NO: 5078 - DNA, 20 bp, Artificial Sequence
  Synthetic polynucleotide
cctggagcacctggagcacc

SEQ ID NO: 5079 - DNA, 20 bp, Artificial Sequence
  Synthetic polynucleotide
atgagggacactatatgatg

SEQ ID NO: 5080 - DNA, 20 bp, Artificial Sequence
  Synthetic polynucleotide
accggccggccttcgccgac

SEQ ID NO: 5081 - DNA, 20 bp, Artificial Sequence
  Synthetic polynucleotide
ccgttcgcggcggacggcgg

SEQ ID NO: 5082 - DNA, 20 bp, Artificial Sequence
  Synthetic polynucleotide
tgggacttgcgcacgaacat

SEQ ID NO: 5083 - DNA, 20 bp, Artificial Sequence
  Synthetic polynucleotide
atgaatggacttcgacttca

SEQ ID NO: 5084 - DNA, 20 bp, Artificial Sequence
  Synthetic polynucleotide
actactataccggatggata

SEQ ID NO: 5085 - DNA, 20 bp, Artificial Sequence
  Synthetic polynucleotide
aggacaagcagattcattca

SEQ ID NO: 5086 - DNA, 20 bp, Artificial Sequence
  Synthetic polynucleotide
ctcaaggaggttgtggtggt

SEQ ID NO: 5087 - DNA, 20 bp, Artificial Sequence
  Synthetic polynucleotide
cggcgggccacactctgcct

SEQ ID NO: 5088 - DNA, 20 bp, Artificial Sequence
  Synthetic polynucleotide
cgtgcggcccgccgcgagtg

SEQ ID NO: 5089 - DNA, 20 bp, Artificial Sequence
  Synthetic polynucleotide
tctgccgggtggaggtccgc

SEQ ID NO: 5090 - DNA, 20 bp, Artificial Sequence
  Synthetic polynucleotide
ggcggccggaagggcgcggc

SEQ ID NO: 5091 - DNA, 20 bp, Artificial Sequence
  Synthetic polynucleotide
caccaaggaaaggagcacca

SEQ ID NO: 5092 - DNA, 20 bp, Artificial Sequence
  Synthetic polynucleotide
cggtgctgccgctcgtgctt

SEQ ID NO: 5093 - DNA, 20 bp, Artificial Sequence
  Synthetic polynucleotide
ggcgggatgagtgcggtgtg

SEQ ID NO: 5094 - DNA, 20 bp, Artificial Sequence
  Synthetic polynucleotide
acgccctggagaaggaggga

SEQ ID NO: 5095 - DNA, 20 bp, Artificial Sequence
  Synthetic polynucleotide
ggcgcctgccccggccggcc

SEQ ID NO: 5096 - DNA, 20 bp, Artificial Sequence
  Synthetic polynucleotide
tggacgggctgcagggtggt

SEQ ID NO: 5097 - DNA, 20 bp, Artificial Sequence
  Synthetic polynucleotide
cctttggcacagcggcacag

SEQ ID NO: 5098 - DNA, 20 bp, Artificial Sequence
  Synthetic polynucleotide
tcctgctgtccctaggaccc

SEQ ID NO: 5099 - DNA, 20 bp, Artificial Sequence
  Synthetic polynucleotide
ggcaccgcataggggagggg

SEQ ID NO: 5100 - DNA, 20 bp, Artificial Sequence
  Synthetic polynucleotide
acctactgtccccagaggag

SEQ ID NO: 5101 - DNA, 20 bp, Artificial Sequence
  Synthetic polynucleotide
agcgcatgaggatgcgcatg

SEQ ID NO: 5102 - DNA, 20 bp, Artificial Sequence
  Synthetic polynucleotide
ttcctcgccccacggctcca

SEQ ID NO: 5103 - DNA, 20 bp, Artificial Sequence
  Synthetic polynucleotide
aaggcgctgctgctctgcgc

SEQ ID NO: 5104 - DNA, 20 bp, Artificial Sequence
  Synthetic polynucleotide
cctggtgctcctggtgctcc

SEQ ID NO: 5105 - DNA, 20 bp, Artificial Sequence
  Synthetic polynucleotide
gggccgggcccggccgggcc

SEQ ID NO: 5106 - DNA, 20 bp, Artificial Sequence
  Synthetic polynucleotide
gggacccaggcacttctgca

SEQ ID NO: 5107 - DNA, 20 bp, Artificial Sequence
  Synthetic polynucleotide
tactgtcggatttctgctgt

SEQ ID NO: 5108 - DNA, 20 bp, Artificial Sequence
  Synthetic polynucleotide
cggagtgaatcagctcagct

SEQ ID NO: 5109 - DNA, 20 bp, Artificial Sequence
  Synthetic polynucleotide
aaggcggaatggtggtggag

SEQ ID NO: 5110 - DNA, 20 bp, Artificial Sequence
  Synthetic polynucleotide
gtggctggcgcaggcgggcg

SEQ ID NO: 5111 - DNA, 20 bp, Artificial Sequence
  Synthetic polynucleotide
gggctggcgcggggctggcg

SEQ ID NO: 5112 - DNA, 20 bp, Artificial Sequence
  Synthetic polynucleotide
tggggccctgggggaagcct

SEQ ID NO: 5113 - DNA, 20 bp, Artificial Sequence
  Synthetic polynucleotide
gggctttctttccgaggccg

SEQ ID NO: 5114 - DNA, 20 bp, Artificial Sequence
  Synthetic polynucleotide
catgaccttcctgcagccag

SEQ ID NO: 5115 - DNA, 20 bp, Artificial Sequence
  Synthetic polynucleotide
ctgaaggggaaggctcgaag

SEQ ID NO: 5116 - DNA, 20 bp, Artificial Sequence
  Synthetic polynucleotide
acgttgccaaagtagtcagt

SEQ ID NO: 5117 - DNA, 20 bp, Artificial Sequence
  Synthetic polynucleotide
cagggcagcgatgcactcac

SEQ ID NO: 5118 - DNA, 20 bp, Artificial Sequence
  Synthetic polynucleotide
ccgtttcataggaaatgggt

SEQ ID NO: 5119 - DNA, 20 bp, Artificial Sequence
  Synthetic polynucleotide
ctcccgagttctgggaggga

SEQ ID NO: 5120 - DNA, 20 bp, Artificial Sequence
  Synthetic polynucleotide
ttggccatgctgatgttggt

SEQ ID NO: 5121 - DNA, 20 bp, Artificial Sequence
  Synthetic polynucleotide
aatggtcttgtgaagggtga

SEQ ID NO: 5122 - DNA, 20 bp, Artificial Sequence
  Synthetic polynucleotide
gctccgcgcttgagggcgga

SEQ ID NO: 5123 - DNA, 20 bp, Artificial Sequence
  Synthetic polynucleotide
gtgggagctggacctggacc

SEQ ID NO: 5124 - DNA, 20 bp, Artificial Sequence
  Synthetic polynucleotide
tgggcaaggtgtggcgggca

SEQ ID NO: 5125 - DNA, 20 bp, Artificial Sequence
  Synthetic polynucleotide
tgttccaggacagcaaggca

SEQ ID NO: 5126 - DNA, 20 bp, Artificial Sequence
  Synthetic polynucleotide
agcaaggtgcaggtgggtgc

SEQ ID NO: 5127 - DNA, 20 bp, Artificial Sequence
  Synthetic polynucleotide
ccggggtccaggcagcaggc

SEQ ID NO: 5128 - DNA, 20 bp, Artificial Sequence
  Synthetic polynucleotide
ctctttccccgtgccaggca

SEQ ID NO: 5129 - DNA, 20 bp, Artificial Sequence
  Synthetic polynucleotide
ctgtctccagcggtgcggtg

SEQ ID NO: 5130 - DNA, 20 bp, Artificial Sequence
  Synthetic polynucleotide
gcgggggtgcggccgaggcg

SEQ ID NO: 5131 - DNA, 20 bp, Artificial Sequence
  Synthetic polynucleotide
cgtaggcggcgggcggcgcg

SEQ ID NO: 5132 - DNA, 20 bp, Artificial Sequence
  Synthetic polynucleotide
caggaacagcaggagggagc

SEQ ID NO: 5133 - DNA, 20 bp, Artificial Sequence
  Synthetic polynucleotide
gaccgcaagatggaggtggg

SEQ ID NO: 5134 - DNA, 20 bp, Artificial Sequence
  Synthetic polynucleotide
tcgttcctccgagctggagc

SEQ ID NO: 5135 - DNA, 20 bp, Artificial Sequence
  Synthetic polynucleotide
gtgacgcctcgctggagggc

SEQ ID NO: 5136 - DNA, 20 bp, Artificial Sequence
  Synthetic polynucleotide
ggcggagctgctggagctgc

SEQ ID NO: 5137 - DNA, 20 bp, Artificial Sequence
  Synthetic polynucleotide
agctgcggctgcagcagctg

SEQ ID NO: 5138 - DNA, 20 bp, Artificial Sequence
  Synthetic polynucleotide
ctcttgcctgcagggcaggc

SEQ ID NO: 5139 - DNA, 20 bp, Artificial Sequence
  Synthetic polynucleotide
aaggggctctgtggacagac

SEQ ID NO: 5140 - DNA, 20 bp, Artificial Sequence
  Synthetic polynucleotide
gtgcgaggtcggcatgaggt

SEQ ID NO: 5141 - DNA, 20 bp, Artificial Sequence
  Synthetic polynucleotide
tctgctttgctttgctttgc

SEQ ID NO: 5142 - DNA, 20 bp, Artificial Sequence
  Synthetic polynucleotide
tgtggctgcagctgtctgct

SEQ ID NO: 5143 - DNA, 20 bp, Artificial Sequence
  Synthetic polynucleotide
tgcactcaaagggcactcaa

SEQ ID NO: 5144 - DNA, 20 bp, Artificial Sequence
  Synthetic polynucleotide
tgtggtcggttctgcagatg

SEQ ID NO: 5145 - DNA, 20 bp, Artificial Sequence
  Synthetic polynucleotide
gtggtctgccagctaaataa

SEQ ID NO: 5146 - DNA, 20 bp, Artificial Sequence
  Synthetic polynucleotide
ccaacgaccatacccgtccg

SEQ ID NO: 5147 - DNA, 20 bp, Artificial Sequence
  Synthetic polynucleotide
tttggagggaaagtagagag

SEQ ID NO: 5148 - DNA, 20 bp, Artificial Sequence
  Synthetic polynucleotide
ttctagcggccatcgaggga

SEQ ID NO: 5149 - DNA, 20 bp, Artificial Sequence
  Synthetic polynucleotide
gactctcgttctctcaggac

SEQ ID NO: 5150 - DNA, 20 bp, Artificial Sequence
  Synthetic polynucleotide
cttcggctacagctacagct

SEQ ID NO: 5151 - DNA, 20 bp, Artificial Sequence
  Synthetic polynucleotide
gccagggccctgcgcgtgta

SEQ ID NO: 5152 - DNA, 20 bp, Artificial Sequence
  Synthetic polynucleotide
tgcttggagcagggggtgct

SEQ ID NO: 5153 - DNA, 20 bp, Artificial Sequence
  Synthetic polynucleotide
cctggacttccagctggtgg

SEQ ID NO: 5154 - DNA, 20 bp, Artificial Sequence
  Synthetic polynucleotide
ggagatggaggccgggaggc

SEQ ID NO: 5155 - DNA, 20 bp, Artificial Sequence
  Synthetic polynucleotide
tgcgtggcacgatacctgcg

SEQ ID NO: 5156 - DNA, 20 bp, Artificial Sequence
  Synthetic polynucleotide
cctggtccccctggtccccc

SEQ ID NO: 5157 - DNA, 20 bp, Artificial Sequence
  Synthetic polynucleotide
ctgaacagccaggtagcgag

SEQ ID NO: 5158 - DNA, 20 bp, Artificial Sequence
  Synthetic polynucleotide
cggttggtctgttgtgactc

SEQ ID NO: 5159 - DNA, 20 bp, Artificial Sequence
  Synthetic polynucleotide
agggggtgcagggccggccg

SEQ ID NO: 5160 - DNA, 20 bp, Artificial Sequence
  Synthetic polynucleotide
accagcgattacgacgacgt

SEQ ID NO: 5161 - DNA, 20 bp, Artificial Sequence
  Synthetic polynucleotide
ggtggcggtgttgtacgtgg

SEQ ID NO: 5162 - DNA, 20 bp, Artificial Sequence
  Synthetic polynucleotide
tgggcggcggcggcgcggcg

SEQ ID NO: 5163 - DNA, 20 bp, Artificial Sequence
  Synthetic polynucleotide
tatctgaaaaattggaaaat

SEQ ID NO: 5164 - DNA, 20 bp, Artificial Sequence
  Synthetic polynucleotide
tggacgggctgcagggctgc

SEQ ID NO: 5165 - DNA, 20 bp, Artificial Sequence
  Synthetic polynucleotide
gtcggcgcagacactgggtt

SEQ ID NO: 5166 - DNA, 20 bp, Artificial Sequence
  Synthetic polynucleotide
ttttagcctccacaggcgag

SEQ ID NO: 5167 - DNA, 20 bp, Artificial Sequence
  Synthetic polynucleotide
ctttacgtaaatcgtaaatg

SEQ ID NO: 5168 - DNA, 20 bp, Artificial Sequence
  Synthetic polynucleotide
agcggcggcggcagcggcgg

SEQ ID NO: 5169 - DNA, 20 bp, Artificial Sequence
  Synthetic polynucleotide
aagccgcagacgtcggccgt

SEQ ID NO: 5170 - DNA, 20 bp, Artificial Sequence
  Synthetic polynucleotide
gttggaaacagtctagtctt

SEQ ID NO: 5171 - DNA, 20 bp, Artificial Sequence
  Synthetic polynucleotide
acactggatatttgagccac

SEQ ID NO: 5172 - DNA, 20 bp, Artificial Sequence
  Synthetic polynucleotide
ccggcggtggggcggtgggg

SEQ ID NO: 5173 - DNA, 20 bp, Artificial Sequence
  Synthetic polynucleotide
catccgttggacacctccgt

SEQ ID NO: 5174 - DNA, 20 bp, Artificial Sequence
  Synthetic polynucleotide
ccttgtgggggccagccaga

SEQ ID NO: 5175 - DNA, 20 bp, Artificial Sequence
  Synthetic polynucleotide
ccggatgtagatcttccacc

SEQ ID NO: 5176 - DNA, 20 bp, Artificial Sequence
  Synthetic polynucleotide
agctttgataccactcggct

SEQ ID NO: 5177 - DNA, 20 bp, Artificial Sequence
  Synthetic polynucleotide
ctgggctgtgaatgagggag

SEQ ID NO: 5178 - DNA, 20 bp, Artificial Sequence
  Synthetic polynucleotide
agcggagggcgcggggcgcg

SEQ ID NO: 5179 - DNA, 20 bp, Artificial Sequence
  Synthetic polynucleotide
tgcaggtatgtcctatgtcc

SEQ ID NO: 5180 - DNA, 20 bp, Artificial Sequence
  Synthetic polynucleotide
cttctgtgaaatgtttgttt

SEQ ID NO: 5181 - DNA, 20 bp, Artificial Sequence
  Synthetic polynucleotide
tggcgggggcggcggcgggg

SEQ ID NO: 5182 - DNA, 20 bp, Artificial Sequence
  Synthetic polynucleotide
aggaggtgggggctggggcg

SEQ ID NO: 5183 - DNA, 20 bp, Artificial Sequence
  Synthetic polynucleotide
aacagtgatctacagtgatc

SEQ ID NO: 5184 - DNA, 20 bp, Artificial Sequence
  Synthetic polynucleotide
ctgagaaggttgccccgaga

SEQ ID NO: 5185 - DNA, 20 bp, Artificial Sequence
  Synthetic polynucleotide
cagaaggcagctggcgggga

SEQ ID NO: 5186 - DNA, 20 bp, Artificial Sequence
  Synthetic polynucleotide
aggatgacgctcctgaggcc

SEQ ID NO: 5187 - DNA, 20 bp, Artificial Sequence
  Synthetic polynucleotide
tccacatctttctgtataaa

SEQ ID NO: 5188 - DNA, 20 bp, Artificial Sequence
  Synthetic polynucleotide
ctgctgccggcactggacac

SEQ ID NO: 5189 - DNA, 20 bp, Artificial Sequence
  Synthetic polynucleotide
tctgctgggctgttgatgag

SEQ ID NO: 5190 - DNA, 20 bp, Artificial Sequence
  Synthetic polynucleotide
gccggaacagcacggaatcc

SEQ ID NO: 5191 - DNA, 20 bp, Artificial Sequence
  Synthetic polynucleotide
taaaggaatttatgaattta

SEQ ID NO: 5192 - DNA, 20 bp, Artificial Sequence
  Synthetic polynucleotide
acatcaagcgccgggacatc

SEQ ID NO: 5193 - DNA, 20 bp, Artificial Sequence
  Synthetic polynucleotide
cactaccccccgcggaagag

SEQ ID NO: 5194 - DNA, 20 bp, Artificial Sequence
  Synthetic polynucleotide
aagctggcgggaccacacac

SEQ ID NO: 5195 - DNA, 20 bp, Artificial Sequence
  Synthetic polynucleotide
cgggggagctgcagtccgtc

SEQ ID NO: 5196 - DNA, 20 bp, Artificial Sequence
  Synthetic polynucleotide
tgtgctcactctgccaggcc

SEQ ID NO: 5197 - DNA, 20 bp, Artificial Sequence
  Synthetic polynucleotide
caaggaaaagccaggcccca

SEQ ID NO: 5198 - DNA, 20 bp, Artificial Sequence
  Synthetic polynucleotide
cttatggcagaattggccat

SEQ ID NO: 5199 - DNA, 20 bp, Artificial Sequence
  Synthetic polynucleotide
ttcagctcctgcatggtgca

SEQ ID NO: 5200 - DNA, 20 bp, Artificial Sequence
  Synthetic polynucleotide
gagaggagctggacttgctg

SEQ ID NO: 5201 - DNA, 20 bp, Artificial Sequence
  Synthetic polynucleotide
tgtccgcggcatgcggcatg

SEQ ID NO: 5202 - DNA, 20 bp, Artificial Sequence
  Synthetic polynucleotide
atgctcaatctgatagaaga

SEQ ID NO: 5203 - DNA, 20 bp, Artificial Sequence
  Synthetic polynucleotide
tcaggctccccaaccaggca

SEQ ID NO: 5204 - DNA, 20 bp, Artificial Sequence
  Synthetic polynucleotide
cggggggcggcggcggccgg

SEQ ID NO: 5205 - DNA, 20 bp, Artificial Sequence
  Synthetic polynucleotide
tgtaggggttcagcagggca

SEQ ID NO: 5206 - DNA, 20 bp, Artificial Sequence
  Synthetic polynucleotide
atgaagaaaagaaaagaaaa

SEQ ID NO: 5207 - DNA, 20 bp, Artificial Sequence
  Synthetic polynucleotide
actccccggctttcggcttt

SEQ ID NO: 5208 - DNA, 20 bp, Artificial Sequence
  Synthetic polynucleotide
ggtggcgggctgggccagcc

SEQ ID NO: 5209 - DNA, 20 bp, Artificial Sequence
  Synthetic polynucleotide
gtcttccagctggggaatgt

SEQ ID NO: 5210 - DNA, 20 bp, Artificial Sequence
  Synthetic polynucleotide
aataaaagaaaagaaaagat

SEQ ID NO: 5211 - DNA, 20 bp, Artificial Sequence
  Synthetic polynucleotide
tccattgtctcctcgaggtc

SEQ ID NO: 5212 - DNA, 20 bp, Artificial Sequence
  Synthetic polynucleotide
cgtggtctcggtcattggcg

SEQ ID NO: 5213 - DNA, 20 bp, Artificial Sequence
  Synthetic polynucleotide
aggaccgggagcaccaggac

SEQ ID NO: 5214 - DNA, 20 bp, Artificial Sequence
  Synthetic polynucleotide
cggctgcagcagcagccagc

SEQ ID NO: 5215 - DNA, 20 bp, Artificial Sequence
  Synthetic polynucleotide
ctccttccacggcacctgcc

SEQ ID NO: 5216 - DNA, 20 bp, Artificial Sequence
  Synthetic polynucleotide
gtgggcgagtgtcggtcttc

SEQ ID NO: 5217 - DNA, 20 bp, Artificial Sequence
  Synthetic polynucleotide
ctggacaaggctgggctccc

SEQ ID NO: 5218 - DNA, 20 bp, Artificial Sequence
  Synthetic polynucleotide
ggcggaggcggaggcggagg

SEQ ID NO: 5219 - DNA, 20 bp, Artificial Sequence
  Synthetic polynucleotide
ggtccgggcgtgcgggcgtg

SEQ ID NO: 5220 - DNA, 20 bp, Artificial Sequence
  Synthetic polynucleotide
gttgggagcaacaagtgatg

SEQ ID NO: 5221 - DNA, 20 bp, Artificial Sequence
  Synthetic polynucleotide
ctgggcccgggcccgggccc

SEQ ID NO: 5222 - DNA, 20 bp, Artificial Sequence
  Synthetic polynucleotide
gagctgccccggagccgccc

SEQ ID NO: 5223 - DNA, 20 bp, Artificial Sequence
  Synthetic polynucleotide
tgcgcgcgcgcgccgcgccg

SEQ ID NO: 5224 - DNA, 20 bp, Artificial Sequence
  Synthetic polynucleotide
ggccccggggcgacgcgacg

SEQ ID NO: 5225 - DNA, 20 bp, Artificial Sequence
  Synthetic polynucleotide
gcattgcacaggtattgcac

SEQ ID NO: 5226 - DNA, 20 bp, Artificial Sequence
  Synthetic polynucleotide
agcggcagccgcggcagcag

SEQ ID NO: 5227 - DNA, 20 bp, Artificial Sequence
  Synthetic polynucleotide
gcctgaaaaatggtacagtc

SEQ ID NO: 5228 - DNA, 20 bp, Artificial Sequence
  Synthetic polynucleotide
ggcttccaccagggaagaca

SEQ ID NO: 5229 - DNA, 20 bp, Artificial Sequence
  Synthetic polynucleotide
agacgcaggaagaaagacgc

SEQ ID NO: 5230 - DNA, 20 bp, Artificial Sequence
  Synthetic polynucleotide
tcttacccacacactttggt

SEQ ID NO: 5231 - DNA, 20 bp, Artificial Sequence
  Synthetic polynucleotide
cttcccggtgctgtggtctg

SEQ ID NO: 5232 - DNA, 20 bp, Artificial Sequence
  Synthetic polynucleotide
ttaatgacaaggaaattaat

SEQ ID NO: 5233 - DNA, 20 bp, Artificial Sequence
  Synthetic polynucleotide
gaaggcagggacttgacttg

SEQ ID NO: 5234 - DNA, 20 bp, Artificial Sequence
  Synthetic polynucleotide
catgggcgcgcgcgcccaca

SEQ ID NO: 5235 - DNA, 20 bp, Artificial Sequence
  Synthetic polynucleotide
caggcagccgagaaggtcgc

SEQ ID NO: 5236 - DNA, 20 bp, Artificial Sequence
  Synthetic polynucleotide
ccatcaccaacaacattgat

SEQ ID NO: 5237 - DNA, 20 bp, Artificial Sequence
  Synthetic polynucleotide
ctttgtggcggaactggggg

SEQ ID NO: 5238 - DNA, 20 bp, Artificial Sequence
  Synthetic polynucleotide
gacggtgaagacggttaaga

SEQ ID NO: 5239 - DNA, 20 bp, Artificial Sequence
  Synthetic polynucleotide
gtatcttggactggacatct

SEQ ID NO: 5240 - DNA, 20 bp, Artificial Sequence
  Synthetic polynucleotide
ctgttgctgctgctgctgct

SEQ ID NO: 5241 - DNA, 20 bp, Artificial Sequence
  Synthetic polynucleotide
accattttgtgtttgtttga

SEQ ID NO: 5242 - DNA, 20 bp, Artificial Sequence
  Synthetic polynucleotide
ttgaagtactgggggatgga

SEQ ID NO: 5243 - DNA, 20 bp, Artificial Sequence
  Synthetic polynucleotide
accacaggtgagcaccgacc

SEQ ID NO: 5244 - DNA, 20 bp, Artificial Sequence
  Synthetic polynucleotide
tcccccagtggattgggtgg

SEQ ID NO: 5245 - DNA, 20 bp, Artificial Sequence
  Synthetic polynucleotide
gtggttgggatggggctgga

SEQ ID NO: 5246 - DNA, 20 bp, Artificial Sequence
  Synthetic polynucleotide
cgctcatagagtaaactaac

SEQ ID NO: 5247 - DNA, 20 bp, Artificial Sequence
  Synthetic polynucleotide
ccgggagacggggctggaga

SEQ ID NO: 5248 - DNA, 20 bp, Artificial Sequence
  Synthetic polynucleotide
accagggcagctacggtttc

SEQ ID NO: 5249 - DNA, 20 bp, Artificial Sequence
  Synthetic polynucleotide
ttgcaccataagacttgact

SEQ ID NO: 5250 - DNA, 20 bp, Artificial Sequence
  Synthetic polynucleotide
tacaccgaggacgtggggtg

SEQ ID NO: 5251 - DNA, 20 bp, Artificial Sequence
  Synthetic polynucleotide
attttgtggattctattttg

SEQ ID NO: 5252 - DNA, 20 bp, Artificial Sequence
  Synthetic polynucleotide
tctccaggtctggtgtggcg

SEQ ID NO: 5253 - DNA, 20 bp, Artificial Sequence
  Synthetic polynucleotide
ttgttgcagatacatctatc

SEQ ID NO: 5254 - DNA, 20 bp, Artificial Sequence
  Synthetic polynucleotide
tccctgcccccaggagtgag

SEQ ID NO: 5255 - DNA, 20 bp, Artificial Sequence
  Synthetic polynucleotide
atcagtggggcgctggagtg

SEQ ID NO: 5256 - DNA, 20 bp, Artificial Sequence
  Synthetic polynucleotide
gaggagctcaacctgtgggt

SEQ ID NO: 5257 - DNA, 20 bp, Artificial Sequence
  Synthetic polynucleotide
ccctggagcgcaagttcccc

SEQ ID NO: 5258 - DNA, 20 bp, Artificial Sequence
  Synthetic polynucleotide
ctgcagtttggctacaacac

SEQ ID NO: 5259 - DNA, 20 bp, Artificial Sequence
  Synthetic polynucleotide
gcagttgaactctggaactc

SEQ ID NO: 5260 - DNA, 20 bp, Artificial Sequence
  Synthetic polynucleotide
gaggcttcagcaccagcagg

SEQ ID NO: 5261 - DNA, 20 bp, Artificial Sequence
  Synthetic polynucleotide
caggatgccgactggccagc

SEQ ID NO: 5262 - DNA, 20 bp, Artificial Sequence
  Synthetic polynucleotide
agagtgttcatctgggaatc

SEQ ID NO: 5263 - DNA, 20 bp, Artificial Sequence
  Synthetic polynucleotide
ccgtgtacgcaaagtcaaac

SEQ ID NO: 5264 - DNA, 20 bp, Artificial Sequence
  Synthetic polynucleotide
gaggaggaggaggaggaggg

SEQ ID NO: 5265 - DNA, 20 bp, Artificial Sequence
  Synthetic polynucleotide
ggtgcagctgtcggtggggt

SEQ ID NO: 5266 - DNA, 20 bp, Artificial Sequence
  Synthetic polynucleotide
catggccgtgagcacccgca

SEQ ID NO: 5267 - DNA, 20 bp, Artificial Sequence
  Synthetic polynucleotide
tgagcgagcgcaggcagcgc

SEQ ID NO: 5268 - DNA, 20 bp, Artificial Sequence
  Synthetic polynucleotide
cctctgagcctggaatctct

SEQ ID NO: 5269 - DNA, 20 bp, Artificial Sequence
  Synthetic polynucleotide
actgcaaggacaaatctgaa

SEQ ID NO: 5270 - DNA, 20 bp, Artificial Sequence
  Synthetic polynucleotide
caaggggatggtactctctc

SEQ ID NO: 5271 - DNA, 20 bp, Artificial Sequence
  Synthetic polynucleotide
ggctgcagctggccagcagc

SEQ ID NO: 5272 - DNA, 20 bp, Artificial Sequence
  Synthetic polynucleotide
gcagatcgcgcagatcgcgc

SEQ ID NO: 5273 - DNA, 20 bp, Artificial Sequence
  Synthetic polynucleotide
tccttcatgatggttcatga

SEQ ID NO: 5274 - DNA, 20 bp, Artificial Sequence
  Synthetic polynucleotide
gcagctgacagagggttaga

SEQ ID NO: 5275 - DNA, 20 bp, Artificial Sequence
  Synthetic polynucleotide
agctgtgcagagaaggcaga

SEQ ID NO: 5276 - DNA, 20 bp, Artificial Sequence
  Synthetic polynucleotide
gaggtccgctgctgcccccg

SEQ ID NO: 5277 - DNA, 20 bp, Artificial Sequence
  Synthetic polynucleotide
caccatggcaaacaggttct

SEQ ID NO: 5278 - DNA, 20 bp, Artificial Sequence
  Synthetic polynucleotide
actacgtggactgtggactg

SEQ ID NO: 5279 - DNA, 20 bp, Artificial Sequence
  Synthetic polynucleotide
tggcgcgccggcgccggcgc

SEQ ID NO: 5280 - DNA, 20 bp, Artificial Sequence
  Synthetic polynucleotide
gctgctgcagctgctgcagc

SEQ ID NO: 5281 - DNA, 20 bp, Artificial Sequence
  Synthetic polynucleotide
ttggcagtggtggcatgtgg

SEQ ID NO: 5282 - DNA, 20 bp, Artificial Sequence
  Synthetic polynucleotide
gggctgaggtcagtagtagt

SEQ ID NO: 5283 - DNA, 20 bp, Artificial Sequence
  Synthetic polynucleotide
acagggggactccgggactc

SEQ ID NO: 5284 - DNA, 20 bp, Artificial Sequence
  Synthetic polynucleotide
acagggtggagggtggaacg

SEQ ID NO: 5285 - DNA, 20 bp, Artificial Sequence
  Synthetic polynucleotide
ctcttcttggatgatgactc

SEQ ID NO: 5286 - DNA, 20 bp, Artificial Sequence
  Synthetic polynucleotide
tccacgtaaatgaagcgacg

SEQ ID NO: 5287 - DNA, 20 bp, Artificial Sequence
  Synthetic polynucleotide
cggcgcgggcggcggcggcg

SEQ ID NO: 5288 - DNA, 20 bp, Artificial Sequence
  Synthetic polynucleotide
gggaggcggcggaggggcgg

SEQ ID NO: 5289 - DNA, 20 bp, Artificial Sequence
  Synthetic polynucleotide
gcggacctcgggggcggcag

SEQ ID NO: 5290 - DNA, 20 bp, Artificial Sequence
  Synthetic polynucleotide
ttggcggcgtgtgctgtgcc

SEQ ID NO: 5291 - DNA, 20 bp, Artificial Sequence
  Synthetic polynucleotide
cccaacggttaccgttaccg

SEQ ID NO: 5292 - DNA, 20 bp, Artificial Sequence
  Synthetic polynucleotide
ccgccagagcgcgcggggcg

SEQ ID NO: 5293 - DNA, 20 bp, Artificial Sequence
  Synthetic polynucleotide
gcatgaagggctgggaggca

SEQ ID NO: 5294 - DNA, 20 bp, Artificial Sequence
  Synthetic polynucleotide
tgaaaacttgtctcgtctcc

SEQ ID NO: 5295 - DNA, 20 bp, Artificial Sequence
  Synthetic polynucleotide
catgtcaaggagatagatag

SEQ ID NO: 5296 - DNA, 20 bp, Artificial Sequence
  Synthetic polynucleotide
ggtgccattgacatgggcat

SEQ ID NO: 5297 - DNA, 20 bp, Artificial Sequence
  Synthetic polynucleotide
ctgctccacagggttcattc

SEQ ID NO: 5298 - DNA, 20 bp, Artificial Sequence
  Synthetic polynucleotide
aagctggaactctgggactc

SEQ ID NO: 5299 - DNA, 20 bp, Artificial Sequence
  Synthetic polynucleotide
cttctcatgtctccggtctc

SEQ ID NO: 5300 - DNA, 20 bp, Artificial Sequence
  Synthetic polynucleotide
gttgaatttccagcttcagg

SEQ ID NO: 5301 - DNA, 20 bp, Artificial Sequence
  Synthetic polynucleotide
tcaagttcttaggtattctt

SEQ ID NO: 5302 - DNA, 20 bp, Artificial Sequence
  Synthetic polynucleotide
ggcgaggtgttcgggcgctc

SEQ ID NO: 5303 - DNA, 20 bp, Artificial Sequence
  Synthetic polynucleotide
tctgaagaacagaacagaac

SEQ ID NO: 5304 - DNA, 20 bp, Artificial Sequence
  Synthetic polynucleotide
cctgggggtcttcctttgcc

SEQ ID NO: 5305 - DNA, 20 bp, Artificial Sequence
  Synthetic polynucleotide
agctctgcgtgaaccgaacc

SEQ ID NO: 5306 - DNA, 20 bp, Artificial Sequence
  Synthetic polynucleotide
cctccggatggttttggttt

SEQ ID NO: 5307 - DNA, 20 bp, Artificial Sequence
  Synthetic polynucleotide
tacctcagagcagttctggc

SEQ ID NO: 5308 - DNA, 20 bp, Artificial Sequence
  Synthetic polynucleotide
cagggtgccgtggggctggc

SEQ ID NO: 5309 - DNA, 20 bp, Artificial Sequence
  Synthetic polynucleotide
gctgctgctgctcgctgtag

SEQ ID NO: 5310 - DNA, 20 bp, Artificial Sequence
  Synthetic polynucleotide
cagcagcaggagggtcaagc

SEQ ID NO: 5311 - DNA, 20 bp, Artificial Sequence
  Synthetic polynucleotide
ttaaaactgtcttttaaaac

SEQ ID NO: 5312 - DNA, 20 bp, Artificial Sequence
  Synthetic polynucleotide
cacggcgttggtcagcgcgt

SEQ ID NO: 5313 - DNA, 20 bp, Artificial Sequence
  Synthetic polynucleotide
aattcccagcaacaggcaac

SEQ ID NO: 5314 - DNA, 20 bp, Artificial Sequence
  Synthetic polynucleotide
ctagacaatataaataaatc

SEQ ID NO: 5315 - DNA, 20 bp, Artificial Sequence
  Synthetic polynucleotide
agggcacatctgggtgcatc

SEQ ID NO: 5316 - DNA, 20 bp, Artificial Sequence
  Synthetic polynucleotide
aagaataggcacaatagaat

SEQ ID NO: 5317 - DNA, 20 bp, Artificial Sequence
  Synthetic polynucleotide
ggcccggaggctgggcggcc

SEQ ID NO: 5318 - DNA, 20 bp, Artificial Sequence
  Synthetic polynucleotide
gtcaccatcagcctcaatca

SEQ ID NO: 5319 - DNA, 20 bp, Artificial Sequence
  Synthetic polynucleotide
ttcctttagttgggattagt

SEQ ID NO: 5320 - DNA, 20 bp, Artificial Sequence
  Synthetic polynucleotide
gttggggttgggtttgggtt

SEQ ID NO: 5321 - DNA, 20 bp, Artificial Sequence
  Synthetic polynucleotide
cttgggggcgaggcggggcg

SEQ ID NO: 5322 - DNA, 20 bp, Artificial Sequence
  Synthetic polynucleotide
cagtgcctgcgcgatctgcg

SEQ ID NO: 5323 - DNA, 20 bp, Artificial Sequence
  Synthetic polynucleotide
agccttgactgttgagcagc

SEQ ID NO: 5324 - DNA, 20 bp, Artificial Sequence
  Synthetic polynucleotide
aggaagaaaagtatgtgaac

SEQ ID NO: 5325 - DNA, 20 bp, Artificial Sequence
  Synthetic polynucleotide
gtctatgtgctgtgctgtgc

SEQ ID NO: 5326 - DNA, 20 bp, Artificial Sequence
  Synthetic polynucleotide
tacgtcctcgctgcggcatg

SEQ ID NO: 5327 - DNA, 20 bp, Artificial Sequence
  Synthetic polynucleotide
tggggctggctggggctggc

SEQ ID NO: 5328 - DNA, 20 bp, Artificial Sequence
  Synthetic polynucleotide
aagcagaaggcgctgcatgc

SEQ ID NO: 5329 - DNA, 20 bp, Artificial Sequence
  Synthetic polynucleotide
cttgtccgtgcgcctgcctg

SEQ ID NO: 5330 - DNA, 20 bp, Artificial Sequence
  Synthetic polynucleotide
ttagaacatatcatctggtc

SEQ ID NO: 5331 - DNA, 20 bp, Artificial Sequence
  Synthetic polynucleotide
gcaaggtgggcagcagcagc

SEQ ID NO: 5332 - DNA, 20 bp, Artificial Sequence
  Synthetic polynucleotide
gattgtcactatatatatat

SEQ ID NO: 5333 - DNA, 20 bp, Artificial Sequence
  Synthetic polynucleotide
cagccatttcgaaaggcagg

SEQ ID NO: 5334 - DNA, 20 bp, Artificial Sequence
  Synthetic polynucleotide
ggcaccaggacgtatgggta

SEQ ID NO: 5335 - DNA, 20 bp, Artificial Sequence
  Synthetic polynucleotide
aagaactccttgatgcaggc

SEQ ID NO: 5336 - DNA, 20 bp, Artificial Sequence
  Synthetic polynucleotide
cgggacgcattcggggcggg

SEQ ID NO: 5337 - DNA, 20 bp, Artificial Sequence
  Synthetic polynucleotide
gcagggcttcccgcacattg

SEQ ID NO: 5338 - DNA, 20 bp, Artificial Sequence
  Synthetic polynucleotide
atgaggccagtggcagaggg

SEQ ID NO: 5339 - DNA, 20 bp, Artificial Sequence
  Synthetic polynucleotide
gcgcgtccaggtgcggcgtg

SEQ ID NO: 5340 - DNA, 20 bp, Artificial Sequence
  Synthetic polynucleotide
gagtcgtcggtgcggtggtg

SEQ ID NO: 5341 - DNA, 20 bp, Artificial Sequence
  Synthetic polynucleotide
gtcggaggagacgtagaggt

SEQ ID NO: 5342 - DNA, 20 bp, Artificial Sequence
  Synthetic polynucleotide
agggcaggcatgcactgcac

SEQ ID NO: 5343 - DNA, 20 bp, Artificial Sequence
  Synthetic polynucleotide
acatttttaaggtaattaat

SEQ ID NO: 5344 - DNA, 20 bp, Artificial Sequence
  Synthetic polynucleotide
aggcagcatacgcgacgcga

SEQ ID NO: 5345 - DNA, 20 bp, Artificial Sequence
  Synthetic polynucleotide
ttggtatgttatcgttggct

SEQ ID NO: 5346 - DNA, 20 bp, Artificial Sequence
  Synthetic polynucleotide
aggaggcagtggaagaatac

SEQ ID NO: 5347 - DNA, 20 bp, Artificial Sequence
  Synthetic polynucleotide
ggcctcggctggtgctgcct

SEQ ID NO: 5348 - DNA, 20 bp, Artificial Sequence
  Synthetic polynucleotide
ctgcaattgaggcaaaattg

SEQ ID NO: 5349 - DNA, 20 bp, Artificial Sequence
  Synthetic polynucleotide
cctgcgaacatacctagcta

SEQ ID NO: 5350 - DNA, 20 bp, Artificial Sequence
  Synthetic polynucleotide
tgacgtggcgtggcgtggcg

SEQ ID NO: 5351 - DNA, 20 bp, Artificial Sequence
  Synthetic polynucleotide
aggactctcccagccaacgt

SEQ ID NO: 5352 - DNA, 20 bp, Artificial Sequence
  Synthetic polynucleotide
tactggctctgaggtgtgtg

SEQ ID NO: 5353 - DNA, 20 bp, Artificial Sequence
  Synthetic polynucleotide
ggccacaggctctgggccac

SEQ ID NO: 5354 - DNA, 20 bp, Artificial Sequence
  Synthetic polynucleotide
gttcacggggattaccaacc

SEQ ID NO: 5355 - DNA, 20 bp, Artificial Sequence
  Synthetic polynucleotide
agctggctgggaacaccagc

SEQ ID NO: 5356 - DNA, 20 bp, Artificial Sequence
  Synthetic polynucleotide
gcggtgcggcggccgcgcgg

SEQ ID NO: 5357 - DNA, 20 bp, Artificial Sequence
  Synthetic polynucleotide
ttgggcgtcttgtgtcgccc

SEQ ID NO: 5358 - DNA, 20 bp, Artificial Sequence
  Synthetic polynucleotide
ggcgccctccgactgctggc

SEQ ID NO: 5359 - DNA, 20 bp, Artificial Sequence
  Synthetic polynucleotide
agatccaggcctgtggcatg

SEQ ID NO: 5360 - DNA, 20 bp, Artificial Sequence
  Synthetic polynucleotide
ggcggcggcggcggcggcgg

SEQ ID NO: 5361 - DNA, 20 bp, Artificial Sequence
  Synthetic polynucleotide
atcctggatgttgcacggca

SEQ ID NO: 5362 - DNA, 20 bp, Artificial Sequence
  Synthetic polynucleotide
cttcaggctggctggcaggc

SEQ ID NO: 5363 - DNA, 20 bp, Artificial Sequence
  Synthetic polynucleotide
tgactggctggccacggcca

SEQ ID NO: 5364 - DNA, 20 bp, Artificial Sequence
  Synthetic polynucleotide
atggctgcgctgggctgcgc

SEQ ID NO: 5365 - DNA, 20 bp, Artificial Sequence
  Synthetic polynucleotide
ggtgcaggaattgggctatg

SEQ ID NO: 5366 - DNA, 20 bp, Artificial Sequence
  Synthetic polynucleotide
agatgagaaggggaggagaa

SEQ ID NO: 5367 - DNA, 20 bp, Artificial Sequence
  Synthetic polynucleotide
gggccacagagatggcgggc

SEQ ID NO: 5368 - DNA, 20 bp, Artificial Sequence
  Synthetic polynucleotide
ctcatgagtatgaaactgac

SEQ ID NO: 5369 - DNA, 20 bp, Artificial Sequence
  Synthetic polynucleotide
aagttgtccttccgcaggcc

SEQ ID NO: 5370 - DNA, 20 bp, Artificial Sequence
  Synthetic polynucleotide
gaggcccggatgctgaaggg

SEQ ID NO: 5371 - DNA, 20 bp, Artificial Sequence
  Synthetic polynucleotide
gactggatcacagggatcac

SEQ ID NO: 5372 - DNA, 20 bp, Artificial Sequence
  Synthetic polynucleotide
tggccggggccgggggccgg

SEQ ID NO: 5373 - DNA, 20 bp, Artificial Sequence
  Synthetic polynucleotide
cgcagctgtaaaactggggg

SEQ ID NO: 5374 - DNA, 20 bp, Artificial Sequence
  Synthetic polynucleotide
caataaaagctgaggtgctg

SEQ ID NO: 5375 - DNA, 20 bp, Artificial Sequence
  Synthetic polynucleotide
agggtcgaggtaagggaaaa

SEQ ID NO: 5376 - DNA, 20 bp, Artificial Sequence
  Synthetic polynucleotide
gcaagctgggcggggggggg

SEQ ID NO: 5377 - DNA, 20 bp, Artificial Sequence
  Synthetic polynucleotide
aggaaaaggggatcgtggtg

SEQ ID NO: 5378 - DNA, 20 bp, Artificial Sequence
  Synthetic polynucleotide
tccccatggtgatgcaagca

SEQ ID NO: 5379 - DNA, 20 bp, Artificial Sequence
  Synthetic polynucleotide
cacggcgcgcgcgcgcgcgc

SEQ ID NO: 5380 - DNA, 20 bp, Artificial Sequence
  Synthetic polynucleotide
actgaagaggaaaaggataa

SEQ ID NO: 5381 - DNA, 20 bp, Artificial Sequence
  Synthetic polynucleotide
ggggaccgcgggggcggcgg

SEQ ID NO: 5382 - DNA, 20 bp, Artificial Sequence
  Synthetic polynucleotide
aactgtgtggtgatgcgacg

SEQ ID NO: 5383 - DNA, 20 bp, Artificial Sequence
  Synthetic polynucleotide
ggcagcggcggcagctgcag

SEQ ID NO: 5384 - DNA, 20 bp, Artificial Sequence
  Synthetic polynucleotide
tggcctgcacagactggtta

SEQ ID NO: 5385 - DNA, 20 bp, Artificial Sequence
  Synthetic polynucleotide
tggctacgcaggcaggcagg

SEQ ID NO: 5386 - DNA, 20 bp, Artificial Sequence
  Synthetic polynucleotide
tccaaagatggtcaaggtca

SEQ ID NO: 5387 - DNA, 20 bp, Artificial Sequence
  Synthetic polynucleotide
gactttaggcagaggctggc

SEQ ID NO: 5388 - DNA, 20 bp, Artificial Sequence
  Synthetic polynucleotide
ctgacgacgttccgacgttc

SEQ ID NO: 5389 - DNA, 20 bp, Artificial Sequence
  Synthetic polynucleotide
tggccgacagttggatggat

SEQ ID NO: 5390 - DNA, 20 bp, Artificial Sequence
  Synthetic polynucleotide
ggcggcgatgatagacaggt

SEQ ID NO: 5391 - DNA, 20 bp, Artificial Sequence
  Synthetic polynucleotide
gtatgggcggggccagggcg

SEQ ID NO: 5392 - DNA, 20 bp, Artificial Sequence
  Synthetic polynucleotide
acagaatggctcctctcctc

SEQ ID NO: 5393 - DNA, 20 bp, Artificial Sequence
  Synthetic polynucleotide
aacacgctgaagcgcacgca

SEQ ID NO: 5394 - DNA, 20 bp, Artificial Sequence
  Synthetic polynucleotide
ccaatgcaggcctcacacac

SEQ ID NO: 5395 - DNA, 20 bp, Artificial Sequence
  Synthetic polynucleotide
aacagaaaaaagagggaaag

SEQ ID NO: 5396 - DNA, 20 bp, Artificial Sequence
  Synthetic polynucleotide
cgttctttggggccatcatc

SEQ ID NO: 5397 - DNA, 20 bp, Artificial Sequence
  Synthetic polynucleotide
atttcttgccaaggcctgcc

SEQ ID NO: 5398 - DNA, 20 bp, Artificial Sequence
  Synthetic polynucleotide
cgccccgctccgccccgccc

SEQ ID NO: 5399 - DNA, 20 bp, Artificial Sequence
  Synthetic polynucleotide
gctcctgaacgtggaaggaa

SEQ ID NO: 5400 - DNA, 20 bp, Artificial Sequence
  Synthetic polynucleotide
cccggtcttgggacggacgc

SEQ ID NO: 5401 - DNA, 20 bp, Artificial Sequence
  Synthetic polynucleotide
ccttacccaggaggaggcag

SEQ ID NO: 5402 - DNA, 20 bp, Artificial Sequence
  Synthetic polynucleotide
cggccccggggcgacggccc

SEQ ID NO: 5403 - DNA, 20 bp, Artificial Sequence
  Synthetic polynucleotide
gatgagagccgtacgcaggc

SEQ ID NO: 5404 - DNA, 20 bp, Artificial Sequence
  Synthetic polynucleotide
cagcaggggaggcccccagc

SEQ ID NO: 5405 - DNA, 20 bp, Artificial Sequence
  Synthetic polynucleotide
aagaggcgctaccaggcagg

SEQ ID NO: 5406 - DNA, 20 bp, Artificial Sequence
  Synthetic polynucleotide
tgactctccgtccaaggagg

SEQ ID NO: 5407 - DNA, 20 bp, Artificial Sequence
  Synthetic polynucleotide
gaggctgtgcgggaaatgtg

SEQ ID NO: 5408 - DNA, 20 bp, Artificial Sequence
  Synthetic polynucleotide
atctcatcgtttgcgccgcc

SEQ ID NO: 5409 - DNA, 20 bp, Artificial Sequence
  Synthetic polynucleotide
tgcacagagtagaagagaag

SEQ ID NO: 5410 - DNA, 20 bp, Artificial Sequence
  Synthetic polynucleotide
gactgcaaggacagactgca

SEQ ID NO: 5411 - DNA, 20 bp, Artificial Sequence
  Synthetic polynucleotide
cctgttctgaaggcaggtga

SEQ ID NO: 5412 - DNA, 20 bp, Artificial Sequence
  Synthetic polynucleotide
ggtgctcacggccatggcca

SEQ ID NO: 5413 - DNA, 20 bp, Artificial Sequence
  Synthetic polynucleotide
tcccccagaaaaaggtgcaa

SEQ ID NO: 5414 - DNA, 20 bp, Artificial Sequence
  Synthetic polynucleotide
cgggatgaagaaggcgaaga

SEQ ID NO: 5415 - DNA, 20 bp, Artificial Sequence
  Synthetic polynucleotide
ggacagactctggatgactc

SEQ ID NO: 5416 - DNA, 20 bp, Artificial Sequence
  Synthetic polynucleotide
tatttgttcttacaggcaac

SEQ ID NO: 5417 - DNA, 20 bp, Artificial Sequence
  Synthetic polynucleotide
tcttgtgctgcatacggagc

SEQ ID NO: 5418 - DNA, 20 bp, Artificial Sequence
  Synthetic polynucleotide
atcatggtgacacttactta

SEQ ID NO: 5419 - DNA, 20 bp, Artificial Sequence
  Synthetic polynucleotide
agccgcagggcggggggggc

SEQ ID NO: 5420 - DNA, 20 bp, Artificial Sequence
  Synthetic polynucleotide
cagggatggattatatatat

SEQ ID NO: 5421 - DNA, 20 bp, Artificial Sequence
  Synthetic polynucleotide
cgcgaggctgggccgtcgcg

SEQ ID NO: 5422 - DNA, 20 bp, Artificial Sequence
  Synthetic polynucleotide
ggcaggccagaagcagcagc

SEQ ID NO: 5423 - DNA, 20 bp, Artificial Sequence
  Synthetic polynucleotide
ccttttttaaggccttttta

SEQ ID NO: 5424 - DNA, 20 bp, Artificial Sequence
  Synthetic polynucleotide
gctgctgctgctgctgctgc

SEQ ID NO: 5425 - DNA, 20 bp, Artificial Sequence
  Synthetic polynucleotide
ctcatgataaggatgatata

SEQ ID NO: 5426 - DNA, 20 bp, Artificial Sequence
  Synthetic polynucleotide
atctgacgacaaatctgacg

SEQ ID NO: 5427 - DNA, 20 bp, Artificial Sequence
  Synthetic polynucleotide
ccaagctggcactggtgagc

SEQ ID NO: 5428 - DNA, 20 bp, Artificial Sequence
  Synthetic polynucleotide
ttgtccttgtggatgggggg

SEQ ID NO: 5429 - DNA, 20 bp, Artificial Sequence
  Synthetic polynucleotide
ctcccaggcagcggtagtag

SEQ ID NO: 5430 - DNA, 20 bp, Artificial Sequence
  Synthetic polynucleotide
tgtggacctgaagccttcct

SEQ ID NO: 5431 - DNA, 20 bp, Artificial Sequence
  Synthetic polynucleotide
gagctggggtccaggattcc

SEQ ID NO: 5432 - DNA, 20 bp, Artificial Sequence
  Synthetic polynucleotide
atgtgatagaaaagctgggc

SEQ ID NO: 5433 - DNA, 20 bp, Artificial Sequence
  Synthetic polynucleotide
tgaaggcatccttgctctga

SEQ ID NO: 5434 - DNA, 20 bp, Artificial Sequence
  Synthetic polynucleotide
ccgggtgggcggcccgcccg

SEQ ID NO: 5435 - DNA, 20 bp, Artificial Sequence
  Synthetic polynucleotide
atggctgtggagtcctgcct

SEQ ID NO: 5436 - DNA, 20 bp, Artificial Sequence
  Synthetic polynucleotide
cgtgctggcgctcttcgtgc

SEQ ID NO: 5437 - DNA, 20 bp, Artificial Sequence
  Synthetic polynucleotide
ctgggtgtggctcccctggc

SEQ ID NO: 5438 - DNA, 20 bp, Artificial Sequence
  Synthetic polynucleotide
cccgggctcccccggcagta

SEQ ID NO: 5439 - DNA, 20 bp, Artificial Sequence
  Synthetic polynucleotide
aactgaaaagagtgccagcc

SEQ ID NO: 5440 - DNA, 20 bp, Artificial Sequence
  Synthetic polynucleotide
tacggggccaaccaggtagg

SEQ ID NO: 5441 - DNA, 20 bp, Artificial Sequence
  Synthetic polynucleotide
ttctcctccgaggcggcctg

SEQ ID NO: 5442 - DNA, 20 bp, Artificial Sequence
  Synthetic polynucleotide
ggtcgccccctgggctctcc

SEQ ID NO: 5443 - DNA, 20 bp, Artificial Sequence
  Synthetic polynucleotide
cccctggagaccagcatcat

SEQ ID NO: 5444 - DNA, 20 bp, Artificial Sequence
  Synthetic polynucleotide
cagagttccacacggcatca

SEQ ID NO: 5445 - DNA, 20 bp, Artificial Sequence
  Synthetic polynucleotide
ctgcgaaacatctcagcaca

SEQ ID NO: 5446 - DNA, 20 bp, Artificial Sequence
  Synthetic polynucleotide
ctgctcgggccgcgggccgc

SEQ ID NO: 5447 - DNA, 20 bp, Artificial Sequence
  Synthetic polynucleotide
gttggagacagggacaccgt

SEQ ID NO: 5448 - DNA, 20 bp, Artificial Sequence
  Synthetic polynucleotide
agccatagctggggcagggc

SEQ ID NO: 5449 - DNA, 20 bp, Artificial Sequence
  Synthetic polynucleotide
gcttctgtgctcctggctcc

SEQ ID NO: 5450 - DNA, 20 bp, Artificial Sequence
  Synthetic polynucleotide
acacctggaaaggtcaggtc

SEQ ID NO: 5451 - DNA, 20 bp, Artificial Sequence
  Synthetic polynucleotide
gtggagtggagcactcactt

SEQ ID NO: 5452 - DNA, 20 bp, Artificial Sequence
  Synthetic polynucleotide
gcccaaggtggccaagccca

SEQ ID NO: 5453 - DNA, 20 bp, Artificial Sequence
  Synthetic polynucleotide
ccgcggggccccggggcccc

SEQ ID NO: 5454 - DNA, 20 bp, Artificial Sequence
  Synthetic polynucleotide
aatgccatgggcaagtacgt

SEQ ID NO: 5455 - DNA, 20 bp, Artificial Sequence
  Synthetic polynucleotide
cccgatgctgttggcgtaga

SEQ ID NO: 5456 - DNA, 20 bp, Artificial Sequence
  Synthetic polynucleotide
ccttggtcagcggaggcggg

SEQ ID NO: 5457 - DNA, 20 bp, Artificial Sequence
  Synthetic polynucleotide
aggaggactcactggttcac

SEQ ID NO: 5458 - DNA, 20 bp, Artificial Sequence
  Synthetic polynucleotide
tattgatggacatttattga

SEQ ID NO: 5459 - DNA, 20 bp, Artificial Sequence
  Synthetic polynucleotide
cattgggacaaagtatccat

SEQ ID NO: 5460 - DNA, 20 bp, Artificial Sequence
  Synthetic polynucleotide
gaggcctcgtatgttatgtg

SEQ ID NO: 5461 - DNA, 20 bp, Artificial Sequence
  Synthetic polynucleotide
tgtctgcggccgccgtgccg

SEQ ID NO: 5462 - DNA, 20 bp, Artificial Sequence
  Synthetic polynucleotide
cgctgcgcacgtccggtccg

SEQ ID NO: 5463 - DNA, 20 bp, Artificial Sequence
  Synthetic polynucleotide
cacatgagcataactaactc

SEQ ID NO: 5464 - DNA, 20 bp, Artificial Sequence
  Synthetic polynucleotide
attatttcaattggttggta

SEQ ID NO: 5465 - DNA, 20 bp, Artificial Sequence
  Synthetic polynucleotide
gggaacgtcagttaggagtt

SEQ ID NO: 5466 - DNA, 20 bp, Artificial Sequence
  Synthetic polynucleotide
tttcaattcaatacaatacc

SEQ ID NO: 5467 - DNA, 20 bp, Artificial Sequence
  Synthetic polynucleotide
gcagccacagtgtgctgctc

SEQ ID NO: 5468 - DNA, 20 bp, Artificial Sequence
  Synthetic polynucleotide
gtgagcataacactacatac

SEQ ID NO: 5469 - DNA, 20 bp, Artificial Sequence
  Synthetic polynucleotide
ggcgggggtgcggccggggc

SEQ ID NO: 5470 - DNA, 20 bp, Artificial Sequence
  Synthetic polynucleotide
tcaggaggagacgtctcagg

SEQ ID NO: 5471 - DNA, 20 bp, Artificial Sequence
  Synthetic polynucleotide
ctggtggaatggggccctgg

SEQ ID NO: 5472 - DNA, 20 bp, Artificial Sequence
  Synthetic polynucleotide
accgtgcatttctgcatttc

SEQ ID NO: 5473 - DNA, 20 bp, Artificial Sequence
  Synthetic polynucleotide
cgaagctcaaggtggagaca

SEQ ID NO: 5474 - DNA, 20 bp, Artificial Sequence
  Synthetic polynucleotide
tcggcataagtggaccgacc

SEQ ID NO: 5475 - DNA, 20 bp, Artificial Sequence
  Synthetic polynucleotide
ctccagcccgggtcggcggg

SEQ ID NO: 5476 - DNA, 20 bp, Artificial Sequence
  Synthetic polynucleotide
cgcggagcctcgcaggggca

SEQ ID NO: 5477 - DNA, 20 bp, Artificial Sequence
  Synthetic polynucleotide
agagaagtctcgagaccacc

SEQ ID NO: 5478 - DNA, 20 bp, Artificial Sequence
  Synthetic polynucleotide
gcctgggcgcggaggagcgg

SEQ ID NO: 5479 - DNA, 20 bp, Artificial Sequence
  Synthetic polynucleotide
ggcaccaagcggtacgtaca

SEQ ID NO: 5480 - DNA, 20 bp, Artificial Sequence
  Synthetic polynucleotide
catccccgtcgtgctcgctg

SEQ ID NO: 5481 - DNA, 20 bp, Artificial Sequence
  Synthetic polynucleotide
cgggctcggactacggacta

SEQ ID NO: 5482 - DNA, 20 bp, Artificial Sequence
  Synthetic polynucleotide
ggggaggtgtcggccggcct

SEQ ID NO: 5483 - DNA, 20 bp, Artificial Sequence
  Synthetic polynucleotide
gtggaatgaggccgaggccg

SEQ ID NO: 5484 - DNA, 20 bp, Artificial Sequence
  Synthetic polynucleotide
gcggcggcggcggcagcagg

SEQ ID NO: 5485 - DNA, 20 bp, Artificial Sequence
  Synthetic polynucleotide
ccgcatcagcaggggcctgc

SEQ ID NO: 5486 - DNA, 20 bp, Artificial Sequence
  Synthetic polynucleotide
gcatctacaactggggcaac

SEQ ID NO: 5487 - DNA, 20 bp, Artificial Sequence
  Synthetic polynucleotide
ccaatcagtggatcaagttt

SEQ ID NO: 5488 - DNA, 20 bp, Artificial Sequence
  Synthetic polynucleotide
ggccacttgtgccttgtgcc

SEQ ID NO: 5489 - DNA, 20 bp, Artificial Sequence
  Synthetic polynucleotide
agcggcggcaggtggaggag

SEQ ID NO: 5490 - DNA, 20 bp, Artificial Sequence
  Synthetic polynucleotide
agccgcggcagcaccagccg

SEQ ID NO: 5491 - DNA, 20 bp, Artificial Sequence
  Synthetic polynucleotide
gcgaggagcaaggcgacgga

SEQ ID NO: 5492 - DNA, 20 bp, Artificial Sequence
  Synthetic polynucleotide
aggacacagggtagagagcc

SEQ ID NO: 5493 - DNA, 20 bp, Artificial Sequence
  Synthetic polynucleotide
acgaaggcctgtgggtgctg

SEQ ID NO: 5494 - DNA, 20 bp, Artificial Sequence
  Synthetic polynucleotide
caccgcctgctgctgctgct

SEQ ID NO: 5495 - DNA, 20 bp, Artificial Sequence
  Synthetic polynucleotide
cggggcggtttggggcggtt

SEQ ID NO: 5496 - DNA, 20 bp, Artificial Sequence
  Synthetic polynucleotide
cagctccaggtacgtctgtc

SEQ ID NO: 5497 - DNA, 20 bp, Artificial Sequence
  Synthetic polynucleotide
acttttgaggacgctgacgc

SEQ ID NO: 5498 - DNA, 20 bp, Artificial Sequence
  Synthetic polynucleotide
gtagatcggctgctgcagat

SEQ ID NO: 5499 - DNA, 20 bp, Artificial Sequence
  Synthetic polynucleotide
gcccgcagctctgggctggc

SEQ ID NO: 5500 - DNA, 20 bp, Artificial Sequence
  Synthetic polynucleotide
ccagctactggcccagctac

SEQ ID NO: 5501 - DNA, 20 bp, Artificial Sequence
  Synthetic polynucleotide
gggcggggctgggctgggct

SEQ ID NO: 5502 - DNA, 20 bp, Artificial Sequence
  Synthetic polynucleotide
cattgagcaggtcctgcaag

SEQ ID NO: 5503 - DNA, 20 bp, Artificial Sequence
  Synthetic polynucleotide
gccactgcccgggaggcatg

SEQ ID NO: 5504 - DNA, 20 bp, Artificial Sequence
  Synthetic polynucleotide
ggcgggtcgggggcgggcgg

SEQ ID NO: 5505 - DNA, 20 bp, Artificial Sequence
  Synthetic polynucleotide
gcggggagagatgactgact

SEQ ID NO: 5506 - DNA, 20 bp, Artificial Sequence
  Synthetic polynucleotide
aagggaactcctctcctcta

SEQ ID NO: 5507 - DNA, 20 bp, Artificial Sequence
  Synthetic polynucleotide
ggtggctcctggggccgggc

SEQ ID NO: 5508 - DNA, 20 bp, Artificial Sequence
  Synthetic polynucleotide
agttggtccttctcggtcct

SEQ ID NO: 5509 - DNA, 20 bp, Artificial Sequence
  Synthetic polynucleotide
gcgagcgcaggcggcgcagg

SEQ ID NO: 5510 - DNA, 20 bp, Artificial Sequence
  Synthetic polynucleotide
cgggggccgcggcgcggggg

SEQ ID NO: 5511 - DNA, 20 bp, Artificial Sequence
  Synthetic polynucleotide
agtgaagatgacaatcatgt

SEQ ID NO: 5512 - DNA, 20 bp, Artificial Sequence
  Synthetic polynucleotide
agaagtggcactgcctgccc

SEQ ID NO: 5513 - DNA, 20 bp, Artificial Sequence
  Synthetic polynucleotide
tgacccggtagtagggtagt

SEQ ID NO: 5514 - DNA, 20 bp, Artificial Sequence
  Synthetic polynucleotide
cttgagcactgtgagcactg

SEQ ID NO: 5515 - DNA, 20 bp, Artificial Sequence
  Synthetic polynucleotide
atgtttagggtgactgactg

SEQ ID NO: 5516 - DNA, 20 bp, Artificial Sequence
  Synthetic polynucleotide
tcggctgcagcagcagcagc

SEQ ID NO: 5517 - DNA, 20 bp, Artificial Sequence
  Synthetic polynucleotide
gcgcggcgcacgggtccgcg

SEQ ID NO: 5518 - DNA, 20 bp, Artificial Sequence
  Synthetic polynucleotide
ctgagcagcagcagcagcag

SEQ ID NO: 5519 - DNA, 20 bp, Artificial Sequence
  Synthetic polynucleotide
tcagatacagccaggctgat

SEQ ID NO: 5520 - DNA, 20 bp, Artificial Sequence
  Synthetic polynucleotide
ggcaaggaggtggggttgtg

SEQ ID NO: 5521 - DNA, 20 bp, Artificial Sequence
  Synthetic polynucleotide
catatcagtctgtgggactg

SEQ ID NO: 5522 - DNA, 20 bp, Artificial Sequence
  Synthetic polynucleotide
gctggtgctgttggccctgc

SEQ ID NO: 5523 - DNA, 20 bp, Artificial Sequence
  Synthetic polynucleotide
gggcagagacaggtaggtac

SEQ ID NO: 5524 - DNA, 20 bp, Artificial Sequence
  Synthetic polynucleotide
tgttacaagcagctgggcct

SEQ ID NO: 5525 - DNA, 20 bp, Artificial Sequence
  Synthetic polynucleotide
gacaaatctgacatctgacg

SEQ ID NO: 5526 - DNA, 20 bp, Artificial Sequence
  Synthetic polynucleotide
agaaagcaagagtggtggtg

SEQ ID NO: 5527 - DNA, 20 bp, Artificial Sequence
  Synthetic polynucleotide
ggccgtaggcggcgggcggc

SEQ ID NO: 5528 - DNA, 20 bp, Artificial Sequence
  Synthetic polynucleotide
tccagggctggggcagggct

SEQ ID NO: 5529 - DNA, 20 bp, Artificial Sequence
  Synthetic polynucleotide
gtgctgaagatgaaagaaag

SEQ ID NO: 5530 - DNA, 20 bp, Artificial Sequence
  Synthetic polynucleotide
gcccgggaggcgaacccccc

SEQ ID NO: 5531 - DNA, 20 bp, Artificial Sequence
  Synthetic polynucleotide
cgggctgcccggctcgtccc

SEQ ID NO: 5532 - DNA, 20 bp, Artificial Sequence
  Synthetic polynucleotide
tgcggcggcggccgcggctg

SEQ ID NO: 5533 - DNA, 20 bp, Artificial Sequence
  Synthetic polynucleotide
caaggacaaatctgactgca

SEQ ID NO: 5534 - DNA, 20 bp, Artificial Sequence
  Synthetic polynucleotide
ccggggcactgcagctaccg

SEQ ID NO: 5535 - DNA, 20 bp, Artificial Sequence
  Synthetic polynucleotide
actcacgtccatgtagtagt

SEQ ID NO: 5536 - DNA, 20 bp, Artificial Sequence
  Synthetic polynucleotide
gatgtgctctggcgagtaga

SEQ ID NO: 5537 - DNA, 20 bp, Artificial Sequence
  Synthetic polynucleotide
tgccaaggagaaaggtgagg

SEQ ID NO: 5538 - DNA, 20 bp, Artificial Sequence
  Synthetic polynucleotide
cctattattgggaatgggaa

SEQ ID NO: 5539 - DNA, 20 bp, Artificial Sequence
  Synthetic polynucleotide
agggaggcgcgcacgctcgg

SEQ ID NO: 5540 - DNA, 20 bp, Artificial Sequence
  Synthetic polynucleotide
taggcagcctgcactggtgg

SEQ ID NO: 5541 - DNA, 20 bp, Artificial Sequence
  Synthetic polynucleotide
gcagcttctggtctgtctgt

SEQ ID NO: 5542 - DNA, 20 bp, Artificial Sequence
  Synthetic polynucleotide
gcacggcagcgggccctcag

SEQ ID NO: 5543 - DNA, 20 bp, Artificial Sequence
  Synthetic polynucleotide
aatgcttggacgaaaatgct

SEQ ID NO: 5544 - DNA, 20 bp, Artificial Sequence
  Synthetic polynucleotide
gtcgccgatgaagagaagaa

SEQ ID NO: 5545 - DNA, 20 bp, Artificial Sequence
  Synthetic polynucleotide
gctctccacgtcgcccgccc

SEQ ID NO: 5546 - DNA, 20 bp, Artificial Sequence
  Synthetic polynucleotide
gctgcagacggagctgcaga

SEQ ID NO: 5547 - DNA, 20 bp, Artificial Sequence
  Synthetic polynucleotide
gagccaaaaaggccatgcat

SEQ ID NO: 5548 - DNA, 20 bp, Artificial Sequence
  Synthetic polynucleotide
cgggccgtgtgccgccccgc

SEQ ID NO: 5549 - DNA, 20 bp, Artificial Sequence
  Synthetic polynucleotide
ggggcccccacactacgctg

SEQ ID NO: 5550 - DNA, 20 bp, Artificial Sequence
  Synthetic polynucleotide
cagctggcagctgctgctgc

SEQ ID NO: 5551 - DNA, 20 bp, Artificial Sequence
  Synthetic polynucleotide
actgcaaggacaaatctgac

SEQ ID NO: 5552 - DNA, 20 bp, Artificial Sequence
  Synthetic polynucleotide
agtctcaggaactttgaatc

SEQ ID NO: 5553 - DNA, 20 bp, Artificial Sequence
  Synthetic polynucleotide
caggccagtgacaatgagtc

SEQ ID NO: 5554 - DNA, 20 bp, Artificial Sequence
  Synthetic polynucleotide
gggttccttctgaatgatga

SEQ ID NO: 5555 - DNA, 20 bp, Artificial Sequence
  Synthetic polynucleotide
gattcactttcttcctgcct

SEQ ID NO: 5556 - DNA, 20 bp, Artificial Sequence
  Synthetic polynucleotide
gccgcgggagcgagggagcg

SEQ ID NO: 5557 - DNA, 20 bp, Artificial Sequence
  Synthetic polynucleotide
atgagctcactgttctgttc

SEQ ID NO: 5558 - DNA, 20 bp, Artificial Sequence
  Synthetic polynucleotide
tcaggggtctctcttttttt

SEQ ID NO: 5559 - DNA, 20 bp, Artificial Sequence
  Synthetic polynucleotide
gtgggccacagaggccgcag

SEQ ID NO: 5560 - DNA, 20 bp, Artificial Sequence
  Synthetic polynucleotide
ttcaccgtcaccgtccgtcc

SEQ ID NO: 5561 - DNA, 20 bp, Artificial Sequence
  Synthetic polynucleotide
atgaacatgggtatgaacat

SEQ ID NO: 5562 - DNA, 20 bp, Artificial Sequence
  Synthetic polynucleotide
ggtcaaaacgaatatgaata

SEQ ID NO: 5563 - DNA, 20 bp, Artificial Sequence
  Synthetic polynucleotide
cgtggaggaggtggatgagg

SEQ ID NO: 5564 - DNA, 20 bp, Artificial Sequence
  Synthetic polynucleotide
gctggtgctgttggtcctgc

SEQ ID NO: 5565 - DNA, 20 bp, Artificial Sequence
  Synthetic polynucleotide
accaacctggagcgtgagtg

SEQ ID NO: 5566 - DNA, 20 bp, Artificial Sequence
  Synthetic polynucleotide
gagtgcaggactaaagggta

SEQ ID NO: 5567 - DNA, 20 bp, Artificial Sequence
  Synthetic polynucleotide
agcggaggggacaggcaggc

SEQ ID NO: 5568 - DNA, 20 bp, Artificial Sequence
  Synthetic polynucleotide
tacgcttggtatgttatcct

SEQ ID NO: 5569 - DNA, 20 bp, Artificial Sequence
  Synthetic polynucleotide
cagctgcctgactcggtcct

SEQ ID NO: 5570 - DNA, 20 bp, Artificial Sequence
  Synthetic polynucleotide
attgttgtcaatgacggagg

SEQ ID NO: 5571 - DNA, 20 bp, Artificial Sequence
  Synthetic polynucleotide
cgagaggccgaggcggccgg

SEQ ID NO: 5572 - DNA, 20 bp, Artificial Sequence
  Synthetic polynucleotide
atgggggaacgccggagaat

SEQ ID NO: 5573 - DNA, 20 bp, Artificial Sequence
  Synthetic polynucleotide
ccgggccgcggcagcggcag

SEQ ID NO: 5574 - DNA, 20 bp, Artificial Sequence
  Synthetic polynucleotide
caccacatccacagacagac

SEQ ID NO: 5575 - DNA, 20 bp, Artificial Sequence
  Synthetic polynucleotide
ggaggatgaggcgatggcga

SEQ ID NO: 5576 - DNA, 20 bp, Artificial Sequence
  Synthetic polynucleotide
gcagtgtcagcgaggaagcg

SEQ ID NO: 5577 - DNA, 20 bp, Artificial Sequence
  Synthetic polynucleotide
agctgcgagagctgcggctg

SEQ ID NO: 5578 - DNA, 20 bp, Artificial Sequence
  Synthetic polynucleotide
tcttaccaacatctggtcaa

SEQ ID NO: 5579 - DNA, 20 bp, Artificial Sequence
  Synthetic polynucleotide
cgttgcccaggagctagctg

SEQ ID NO: 5580 - DNA, 20 bp, Artificial Sequence
  Synthetic polynucleotide
agcgctcgtggcagcggcgg

SEQ ID NO: 5581 - DNA, 20 bp, Artificial Sequence
  Synthetic polynucleotide
ttcaccaaaggatgactgac

SEQ ID NO: 5582 - DNA, 20 bp, Artificial Sequence
  Synthetic polynucleotide
tcaacaaatcactagaggag

SEQ ID NO: 5583 - DNA, 20 bp, Artificial Sequence
  Synthetic polynucleotide
tcgtaatcgctggtaatcgc

SEQ ID NO: 5584 - DNA, 20 bp, Artificial Sequence
  Synthetic polynucleotide
agggagctcaccagacagac

SEQ ID NO: 5585 - DNA, 20 bp, Artificial Sequence
  Synthetic polynucleotide
gttcgctgaaggggaaggga

SEQ ID NO: 5586 - DNA, 20 bp, Artificial Sequence
  Synthetic polynucleotide
ggtagctgtggatgcggcgg

SEQ ID NO: 5587 - DNA, 20 bp, Artificial Sequence
  Synthetic polynucleotide
ggttcgcctcccgggccccc

SEQ ID NO: 5588 - DNA, 20 bp, Artificial Sequence
  Synthetic polynucleotide
ggccatgtacagcgagcagc

SEQ ID NO: 5589 - DNA, 20 bp, Artificial Sequence
  Synthetic polynucleotide
taaaagcacagtaggacagt

SEQ ID NO: 5590 - DNA, 20 bp, Artificial Sequence
  Synthetic polynucleotide
ctcggcctctcggctcacta

SEQ ID NO: 5591 - DNA, 20 bp, Artificial Sequence
  Synthetic polynucleotide
gcggcgcgggcctcccgcgc

SEQ ID NO: 5592 - DNA, 20 bp, Artificial Sequence
  Synthetic polynucleotide
caggtactcacagatggcgg

SEQ ID NO: 5593 - DNA, 20 bp, Artificial Sequence
  Synthetic polynucleotide
gggcgagcagcgcgcagagc

SEQ ID NO: 5594 - DNA, 20 bp, Artificial Sequence
  Synthetic polynucleotide
ccgccggcccgcgggcccgc

SEQ ID NO: 5595 - DNA, 20 bp, Artificial Sequence
  Synthetic polynucleotide
ggagatctcggaggcatcgg

SEQ ID NO: 5596 - DNA, 20 bp, Artificial Sequence
  Synthetic polynucleotide
gttatggatgccgaagatga

SEQ ID NO: 5597 - DNA, 20 bp, Artificial Sequence
  Synthetic polynucleotide
caaatctgacgagtctgacg

SEQ ID NO: 5598 - DNA, 20 bp, Artificial Sequence
  Synthetic polynucleotide
cccaggagtgaactggtgtc

SEQ ID NO: 5599 - DNA, 20 bp, Artificial Sequence
  Synthetic polynucleotide
agtcatcttcactaatgtaa

SEQ ID NO: 5600 - DNA, 20 bp, Artificial Sequence
  Synthetic polynucleotide
ataggtgttattggaggtgg

SEQ ID NO: 5601 - DNA, 20 bp, Artificial Sequence
  Synthetic polynucleotide
aacccactcacacttcacac

SEQ ID NO: 5602 - DNA, 20 bp, Artificial Sequence
  Synthetic polynucleotide
aagggacatagaaaatcaaa

SEQ ID NO: 5603 - DNA, 20 bp, Artificial Sequence
  Synthetic polynucleotide
ccaggtgccattttggggcc

SEQ ID NO: 5604 - DNA, 20 bp, Artificial Sequence
  Synthetic polynucleotide
aacttattcagaacttattc

SEQ ID NO: 5605 - DNA, 20 bp, Artificial Sequence
  Synthetic polynucleotide
tataactttttggcacaggc

SEQ ID NO: 5606 - DNA, 20 bp, Artificial Sequence
  Synthetic polynucleotide
cggaggccggggggccgcgg

SEQ ID NO: 5607 - DNA, 20 bp, Artificial Sequence
  Synthetic polynucleotide
ccggctgcgctgcgctgcgc

SEQ ID NO: 5608 - DNA, 20 bp, Artificial Sequence
  Synthetic polynucleotide
ggtctttctgcacatttggg

SEQ ID NO: 5609 - DNA, 20 bp, Artificial Sequence
  Synthetic polynucleotide
tgaacttctcctccatcatc

SEQ ID NO: 5610 - DNA, 20 bp, Artificial Sequence
  Synthetic polynucleotide
atccccgcttgtgaacactg

SEQ ID NO: 5611 - DNA, 20 bp, Artificial Sequence
  Synthetic polynucleotide
cctgcgcacgctgcgcacgc

SEQ ID NO: 5612 - DNA, 20 bp, Artificial Sequence
  Synthetic polynucleotide
tgtgaggagtgtgaggagtg

SEQ ID NO: 5613 - DNA, 20 bp, Artificial Sequence
  Synthetic polynucleotide
gacacaagggcctgaagcaa

SEQ ID NO: 5614 - DNA, 20 bp, Artificial Sequence
  Synthetic polynucleotide
ccataacagcatcaggagtc

SEQ ID NO: 5615 - DNA, 20 bp, Artificial Sequence
  Synthetic polynucleotide
gagacaaaccccaggatgct

SEQ ID NO: 5616 - DNA, 20 bp, Artificial Sequence
  Synthetic polynucleotide
gcatctacattgacgacgac

SEQ ID NO: 5617 - DNA, 20 bp, Artificial Sequence
  Synthetic polynucleotide
gacgggtgtctccacagtga

SEQ ID NO: 5618 - DNA, 20 bp, Artificial Sequence
  Synthetic polynucleotide
agcatgcataatgaatgggt

SEQ ID NO: 5619 - DNA, 20 bp, Artificial Sequence
  Synthetic polynucleotide
ggagactcgggagctggagc

SEQ ID NO: 5620 - DNA, 20 bp, Artificial Sequence
  Synthetic polynucleotide
atcgacggcatcggcggcat

SEQ ID NO: 5621 - DNA, 20 bp, Artificial Sequence
  Synthetic polynucleotide
ctccagcagcttgcggtggt

SEQ ID NO: 5622 - DNA, 20 bp, Artificial Sequence
  Synthetic polynucleotide
cccgaagcagggtgtagtgt

SEQ ID NO: 5623 - DNA, 20 bp, Artificial Sequence
  Synthetic polynucleotide
ctaagcaacatgagcttagc

SEQ ID NO: 5624 - DNA, 20 bp, Artificial Sequence
  Synthetic polynucleotide
gcctcggcctctcggcctct

SEQ ID NO: 5625 - DNA, 20 bp, Artificial Sequence
  Synthetic polynucleotide
acgcatgtctcgcggtaccg

SEQ ID NO: 5626 - DNA, 20 bp, Artificial Sequence
  Synthetic polynucleotide
ggcctttgctgtggttgggt

SEQ ID NO: 5627 - DNA, 20 bp, Artificial Sequence
  Synthetic polynucleotide
cccatgacctatactcactc

SEQ ID NO: 5628 - DNA, 20 bp, Artificial Sequence
  Synthetic polynucleotide
cagcttgatgaggtcagatg

SEQ ID NO: 5629 - DNA, 20 bp, Artificial Sequence
  Synthetic polynucleotide
gtgcggccagtggaagaccg

SEQ ID NO: 5630 - DNA, 20 bp, Artificial Sequence
  Synthetic polynucleotide
agctgagctgcgaggtgtcg

SEQ ID NO: 5631 - DNA, 20 bp, Artificial Sequence
  Synthetic polynucleotide
gacaggatggtgaacaggga

SEQ ID NO: 5632 - DNA, 20 bp, Artificial Sequence
  Synthetic polynucleotide
aaggagttgatgagggaggg

SEQ ID NO: 5633 - DNA, 20 bp, Artificial Sequence
  Synthetic polynucleotide
acagggctcgtccaactaac

SEQ ID NO: 5634 - DNA, 20 bp, Artificial Sequence
  Synthetic polynucleotide
ttgaaggccatcacgtatga

SEQ ID NO: 5635 - DNA, 20 bp, Artificial Sequence
  Synthetic polynucleotide
tctcaaggttatgcttctca

SEQ ID NO: 5636 - DNA, 20 bp, Artificial Sequence
  Synthetic polynucleotide
tgctggggatgctgctgctg

SEQ ID NO: 5637 - DNA, 20 bp, Artificial Sequence
  Synthetic polynucleotide
ggcggtgcagccgaaggagg

SEQ ID NO: 5638 - DNA, 20 bp, Artificial Sequence
  Synthetic polynucleotide
gaacatcggggctgcggtgc

SEQ ID NO: 5639 - DNA, 20 bp, Artificial Sequence
  Synthetic polynucleotide
gacccagcccggccaggagc

SEQ ID NO: 5640 - DNA, 20 bp, Artificial Sequence
  Synthetic polynucleotide
ggccgtagtacatgacatga

SEQ ID NO: 5641 - DNA, 20 bp, Artificial Sequence
  Synthetic polynucleotide
cgggagccggaggtggacgg

SEQ ID NO: 5642 - DNA, 20 bp, Artificial Sequence
  Synthetic polynucleotide
caaggacgcctaccatgcat

SEQ ID NO: 5643 - DNA, 20 bp, Artificial Sequence
  Synthetic polynucleotide
ttacagcaccgatgacccag

SEQ ID NO: 5644 - DNA, 20 bp, Artificial Sequence
  Synthetic polynucleotide
gcggaaatgcttgatttcag

SEQ ID NO: 5645 - DNA, 20 bp, Artificial Sequence
  Synthetic polynucleotide
tgactaatctggatcctatc

SEQ ID NO: 5646 - DNA, 20 bp, Artificial Sequence
  Synthetic polynucleotide
acgctcatagagtaactaac

SEQ ID NO: 5647 - DNA, 20 bp, Artificial Sequence
  Synthetic polynucleotide
gtgccggccagccggcccgc

SEQ ID NO: 5648 - DNA, 20 bp, Artificial Sequence
  Synthetic polynucleotide
gcggcgtagggcagcgccag

SEQ ID NO: 5649 - DNA, 20 bp, Artificial Sequence
  Synthetic polynucleotide
caccagtgtgggcttcgtgt

SEQ ID NO: 5650 - DNA, 20 bp, Artificial Sequence
  Synthetic polynucleotide
ggtggtcctgccggaggcgg

SEQ ID NO: 5651 - DNA, 20 bp, Artificial Sequence
  Synthetic polynucleotide
catccgggtggagagcggcg

SEQ ID NO: 5652 - DNA, 20 bp, Artificial Sequence
  Synthetic polynucleotide
aggatgagatgctgcggcgg

SEQ ID NO: 5653 - DNA, 20 bp, Artificial Sequence
  Synthetic polynucleotide
tttgatgaggaggaaggatg

SEQ ID NO: 5654 - DNA, 20 bp, Artificial Sequence
  Synthetic polynucleotide
agatgcaaatgggtgggggg

SEQ ID NO: 5655 - DNA, 20 bp, Artificial Sequence
  Synthetic polynucleotide
gcccttgttgaggtgttgtt

SEQ ID NO: 5656 - DNA, 20 bp, Artificial Sequence
  Synthetic polynucleotide
atcattatgctgaggatttg

SEQ ID NO: 5657 - DNA, 20 bp, Artificial Sequence
  Synthetic polynucleotide
tgaccaaaagcaggaagagc

SEQ ID NO: 5658 - DNA, 20 bp, Artificial Sequence
  Synthetic polynucleotide
aaaggggcggacgctgaggg

SEQ ID NO: 5659 - DNA, 20 bp, Artificial Sequence
  Synthetic polynucleotide
aggccccttgcaatgtgggt

SEQ ID NO: 5660 - DNA, 20 bp, Artificial Sequence
  Synthetic polynucleotide
ccaccgcacttggctgttgt

SEQ ID NO: 5661 - DNA, 20 bp, Artificial Sequence
  Synthetic polynucleotide
acagggtggagggtggaggg

SEQ ID NO: 5662 - DNA, 20 bp, Artificial Sequence
  Synthetic polynucleotide
ggcattttatagctgcttgc

SEQ ID NO: 5663 - DNA, 20 bp, Artificial Sequence
  Synthetic polynucleotide
ggcggtggcggtgccggtgc

SEQ ID NO: 5664 - DNA, 20 bp, Artificial Sequence
  Synthetic polynucleotide
cgtggaaactgtccacaaca

SEQ ID NO: 5665 - DNA, 20 bp, Artificial Sequence
  Synthetic polynucleotide
atcatggaaccagcagcaca

SEQ ID NO: 5666 - DNA, 20 bp, Artificial Sequence
  Synthetic polynucleotide
gcatggttcactctgaacgg

SEQ ID NO: 5667 - DNA, 20 bp, Artificial Sequence
  Synthetic polynucleotide
gctgctgcgcggcggctgcg

SEQ ID NO: 5668 - DNA, 20 bp, Artificial Sequence
  Synthetic polynucleotide
cgctgtccgaggagcgtccg

SEQ ID NO: 5669 - DNA, 20 bp, Artificial Sequence
  Synthetic polynucleotide
cgagtccgactccggtactc

SEQ ID NO: 5670 - DNA, 20 bp, Artificial Sequence
  Synthetic polynucleotide
gactttggaacagaattttc

SEQ ID NO: 5671 - DNA, 20 bp, Artificial Sequence
  Synthetic polynucleotide
caacagcatgattgacagac

SEQ ID NO: 5672 - DNA, 20 bp, Artificial Sequence
  Synthetic polynucleotide
aggcgggcgaggagcggccg

SEQ ID NO: 5673 - DNA, 20 bp, Artificial Sequence
  Synthetic polynucleotide
caagacattcacgtggttcg

SEQ ID NO: 5674 - DNA, 20 bp, Artificial Sequence
  Synthetic polynucleotide
tatgacccaggaagccgagc

SEQ ID NO: 5675 - DNA, 20 bp, Artificial Sequence
  Synthetic polynucleotide
atgaagatgcccaccaccca

SEQ ID NO: 5676 - DNA, 20 bp, Artificial Sequence
  Synthetic polynucleotide
ttcttggaatggccttggaa

SEQ ID NO: 5677 - DNA, 20 bp, Artificial Sequence
  Synthetic polynucleotide
agccgtgctcgtggtgctcg

SEQ ID NO: 5678 - DNA, 20 bp, Artificial Sequence
  Synthetic polynucleotide
tcaaaagacaaggttactta

SEQ ID NO: 5679 - DNA, 20 bp, Artificial Sequence
  Synthetic polynucleotide
atggtgctgctgccccgaaa

SEQ ID NO: 5680 - DNA, 20 bp, Artificial Sequence
  Synthetic polynucleotide
agttttgggattaaagtttt

SEQ ID NO: 5681 - DNA, 20 bp, Artificial Sequence
  Synthetic polynucleotide
aaactgttcttagtgttctt

SEQ ID NO: 5682 - DNA, 20 bp, Artificial Sequence
  Synthetic polynucleotide
cagttgctggcatgagtttt

SEQ ID NO: 5683 - DNA, 20 bp, Artificial Sequence
  Synthetic polynucleotide
tgagggggaagaggagggag

SEQ ID NO: 5684 - DNA, 20 bp, Artificial Sequence
  Synthetic polynucleotide
tcaacgcggcgctcggcgct

SEQ ID NO: 5685 - DNA, 20 bp, Artificial Sequence
  Synthetic polynucleotide
cattatagtcaagggcataa

SEQ ID NO: 5686 - DNA, 20 bp, Artificial Sequence
  Synthetic polynucleotide
taaaagtggaaataggaaat

SEQ ID NO: 5687 - DNA, 20 bp, Artificial Sequence
  Synthetic polynucleotide
gcccatgcaggctgggtggg

SEQ ID NO: 5688 - DNA, 20 bp, Artificial Sequence
  Synthetic polynucleotide
ccgccgggccgggctgggct

SEQ ID NO: 5689 - DNA, 20 bp, Artificial Sequence
  Synthetic polynucleotide
aaaataccaatctattgttg

SEQ ID NO: 5690 - DNA, 20 bp, Artificial Sequence
  Synthetic polynucleotide
gtgctgctgcgtgctgcgtg

SEQ ID NO: 5691 - DNA, 20 bp, Artificial Sequence
  Synthetic polynucleotide
ctgagtgttacaacgaaaaa

SEQ ID NO: 5692 - DNA, 20 bp, Artificial Sequence
  Synthetic polynucleotide
ggcggcggcggcggcagcgg

SEQ ID NO: 5693 - DNA, 20 bp, Artificial Sequence
  Synthetic polynucleotide
actctgcggcaagtcctctg

SEQ ID NO: 5694 - DNA, 20 bp, Artificial Sequence
  Synthetic polynucleotide
gcaggacgcccgcggcgagc

SEQ ID NO: 5695 - DNA, 20 bp, Artificial Sequence
  Synthetic polynucleotide
ggaggcgccgcctgggttgg

SEQ ID NO: 5696 - DNA, 20 bp, Artificial Sequence
  Synthetic polynucleotide
gcgctttatgcggatctatc

SEQ ID NO: 5697 - DNA, 20 bp, Artificial Sequence
  Synthetic polynucleotide
tacttacgaactgctgggtt

SEQ ID NO: 5698 - DNA, 20 bp, Artificial Sequence
  Synthetic polynucleotide
ctcactgtgcatgatgatgt

SEQ ID NO: 5699 - DNA, 20 bp, Artificial Sequence
  Synthetic polynucleotide
cactgtcgatggctgcacga

SEQ ID NO: 5700 - DNA, 20 bp, Artificial Sequence
  Synthetic polynucleotide
gcgggggcggcgggggcggc

SEQ ID NO: 5701 - DNA, 20 bp, Artificial Sequence
  Synthetic polynucleotide
ggttttggtggaggaagtgg

SEQ ID NO: 5702 - DNA, 20 bp, Artificial Sequence
  Synthetic polynucleotide
tttacaaccctttgtttgtt

SEQ ID NO: 5703 - DNA, 20 bp, Artificial Sequence
  Synthetic polynucleotide
cagtgctggcggcgtcctgg

SEQ ID NO: 5704 - DNA, 20 bp, Artificial Sequence
  Synthetic polynucleotide
gaaatcttgaactccactcc

SEQ ID NO: 5705 - DNA, 20 bp, Artificial Sequence
  Synthetic polynucleotide
gcccgcaactacctggaacc

SEQ ID NO: 5706 - DNA, 20 bp, Artificial Sequence
  Synthetic polynucleotide
gagccagatgtgaaggaggg

SEQ ID NO: 5707 - DNA, 20 bp, Artificial Sequence
  Synthetic polynucleotide
tcggatttcattccattcca

SEQ ID NO: 5708 - DNA, 20 bp, Artificial Sequence
  Synthetic polynucleotide
gcctggcgctccatgcggag

SEQ ID NO: 5709 - DNA, 20 bp, Artificial Sequence
  Synthetic polynucleotide
aaggtcagctggtagcgtag

SEQ ID NO: 5710 - DNA, 20 bp, Artificial Sequence
  Synthetic polynucleotide
caccaccgccggagggtcca

SEQ ID NO: 5711 - DNA, 20 bp, Artificial Sequence
  Synthetic polynucleotide
taggcgtttcatcaaacggc

SEQ ID NO: 5712 - DNA, 20 bp, Artificial Sequence
  Synthetic polynucleotide
ggaggaggaggaggaggtgg

SEQ ID NO: 5713 - DNA, 20 bp, Artificial Sequence
  Synthetic polynucleotide
caagaccgggtctcaagacc

SEQ ID NO: 5714 - DNA, 20 bp, Artificial Sequence
  Synthetic polynucleotide
ggcaactgcagcccggacgg

SEQ ID NO: 5715 - DNA, 20 bp, Artificial Sequence
  Synthetic polynucleotide
caggtagacggtggcggtgg

SEQ ID NO: 5716 - DNA, 20 bp, Artificial Sequence
  Synthetic polynucleotide
gaacgatggtggcaatcgaa

SEQ ID NO: 5717 - DNA, 20 bp, Artificial Sequence
  Synthetic polynucleotide
gtcttctccaacttcatcca

SEQ ID NO: 5718 - DNA, 20 bp, Artificial Sequence
  Synthetic polynucleotide
cctggtgctcctggtgctcc

SEQ ID NO: 5719 - DNA, 20 bp, Artificial Sequence
  Synthetic polynucleotide
aggggaacgaggggaacgag

SEQ ID NO: 5720 - DNA, 20 bp, Artificial Sequence
  Synthetic polynucleotide
gaaatgtcgcacggccggcc

SEQ ID NO: 5721 - DNA, 20 bp, Artificial Sequence
  Synthetic polynucleotide
gatggaaaggagatagatac

SEQ ID NO: 5722 - DNA, 20 bp, Artificial Sequence
  Synthetic polynucleotide
catggacgaggccacggctt

SEQ ID NO: 5723 - DNA, 20 bp, Artificial Sequence
  Synthetic polynucleotide
tcctcacgactggaagctca

SEQ ID NO: 5724 - DNA, 20 bp, Artificial Sequence
  Synthetic polynucleotide
aaactgttcatctgtctgtc

SEQ ID NO: 5725 - DNA, 20 bp, Artificial Sequence
  Synthetic polynucleotide
cgccgccgccgtggccgccg

SEQ ID NO: 5726 - DNA, 20 bp, Artificial Sequence
  Synthetic polynucleotide
gcggagcaccccaagccagg

SEQ ID NO: 5727 - DNA, 20 bp, Artificial Sequence
  Synthetic polynucleotide
agcacagtagaactaagtaa

SEQ ID NO: 5728 - DNA, 20 bp, Artificial Sequence
  Synthetic polynucleotide
ccatttggtcagaagacgga

SEQ ID NO: 5729 - DNA, 20 bp, Artificial Sequence
  Synthetic polynucleotide
gtgcggcggaggcgggggtg

SEQ ID NO: 5730 - DNA, 20 bp, Artificial Sequence
  Synthetic polynucleotide
taccgaggtgagcagaggca

SEQ ID NO: 5731 - DNA, 20 bp, Artificial Sequence
  Synthetic polynucleotide
gtgctgcgggacggcggcga

SEQ ID NO: 5732 - DNA, 20 bp, Artificial Sequence
  Synthetic polynucleotide
caggtattacgagacgagac

SEQ ID NO: 5733 - DNA, 20 bp, Artificial Sequence
  Synthetic polynucleotide
tggacagccacacagcacac

SEQ ID NO: 5734 - DNA, 20 bp, Artificial Sequence
  Synthetic polynucleotide
tgcggcggctgcggcggctg

SEQ ID NO: 5735 - DNA, 20 bp, Artificial Sequence
  Synthetic polynucleotide
cacgccctcaggagaggtgg

SEQ ID NO: 5736 - DNA, 20 bp, Artificial Sequence
  Synthetic polynucleotide
cggagaaggggggaagaagt

SEQ ID NO: 5737 - DNA, 20 bp, Artificial Sequence
  Synthetic polynucleotide
tccagctggctggaggaagg

SEQ ID NO: 5738 - DNA, 20 bp, Artificial Sequence
  Synthetic polynucleotide
caataatggctaaacaataa

SEQ ID NO: 5739 - DNA, 20 bp, Artificial Sequence
  Synthetic polynucleotide
gctcgtagatggtggcggcc

SEQ ID NO: 5740 - DNA, 20 bp, Artificial Sequence
  Synthetic polynucleotide
tgcgctgcaggaactgctgc

SEQ ID NO: 5741 - DNA, 20 bp, Artificial Sequence
  Synthetic polynucleotide
ccaggtcggccaggcaggcc

SEQ ID NO: 5742 - DNA, 20 bp, Artificial Sequence
  Synthetic polynucleotide
aaggttggctgtaccaaggt

SEQ ID NO: 5743 - DNA, 20 bp, Artificial Sequence
  Synthetic polynucleotide
gcaggtcacctggtgagtcc

SEQ ID NO: 5744 - DNA, 20 bp, Artificial Sequence
  Synthetic polynucleotide
tctcccagaggaagttatag

SEQ ID NO: 5745 - DNA, 20 bp, Artificial Sequence
  Synthetic polynucleotide
tctcccagatgtggtggttg

SEQ ID NO: 5746 - DNA, 20 bp, Artificial Sequence
  Synthetic polynucleotide
gctggatattcgggatattc

SEQ ID NO: 5747 - DNA, 20 bp, Artificial Sequence
  Synthetic polynucleotide
ctgatgctttgctgatgctt

SEQ ID NO: 5748 - DNA, 20 bp, Artificial Sequence
  Synthetic polynucleotide
aggcccgcgctgaggcggcg

SEQ ID NO: 5749 - DNA, 20 bp, Artificial Sequence
  Synthetic polynucleotide
gccagtgtggaagaacagtg

SEQ ID NO: 5750 - DNA, 20 bp, Artificial Sequence
  Synthetic polynucleotide
gctgttgtctttctgtcttt

SEQ ID NO: 5751 - DNA, 20 bp, Artificial Sequence
  Synthetic polynucleotide
ccagcagggaagctggtgca

SEQ ID NO: 5752 - DNA, 20 bp, Artificial Sequence
  Synthetic polynucleotide
acacactccctggaagtccc

SEQ ID NO: 5753 - DNA, 20 bp, Artificial Sequence
  Synthetic polynucleotide
cacggggctgcggctgctgg

SEQ ID NO: 5754 - DNA, 20 bp, Artificial Sequence
  Synthetic polynucleotide
caccgcctcttctcttggcc

SEQ ID NO: 5755 - DNA, 20 bp, Artificial Sequence
  Synthetic polynucleotide
gaggacctgcagcgggtggg

SEQ ID NO: 5756 - DNA, 20 bp, Artificial Sequence
  Synthetic polynucleotide
ccccggacggtgacggcgga

SEQ ID NO: 5757 - DNA, 20 bp, Artificial Sequence
  Synthetic polynucleotide
ccaggtccacgggcagacga

SEQ ID NO: 5758 - DNA, 20 bp, Artificial Sequence
  Synthetic polynucleotide
tgctcgtggtgatctgctcg

SEQ ID NO: 5759 - DNA, 20 bp, Artificial Sequence
  Synthetic polynucleotide
gcttcgaacccggctgctga

SEQ ID NO: 5760 - DNA, 20 bp, Artificial Sequence
  Synthetic polynucleotide
gatgagcactttatagcgca

SEQ ID NO: 5761 - DNA, 20 bp, Artificial Sequence
  Synthetic polynucleotide
agaccgagttcctatggatg

SEQ ID NO: 5762 - DNA, 20 bp, Artificial Sequence
  Synthetic polynucleotide
ccatgtggctgcatgggacg

SEQ ID NO: 5763 - DNA, 20 bp, Artificial Sequence
  Synthetic polynucleotide
tgtcggccttggggccgggc

SEQ ID NO: 5764 - DNA, 20 bp, Artificial Sequence
  Synthetic polynucleotide
acactctgtgcctgcgtgcg

SEQ ID NO: 5765 - DNA, 20 bp, Artificial Sequence
  Synthetic polynucleotide
cagcaagctgggcggggggg

SEQ ID NO: 5766 - DNA, 20 bp, Artificial Sequence
  Synthetic polynucleotide
tgctctctgtgtagtggtag

SEQ ID NO: 5767 - DNA, 20 bp, Artificial Sequence
  Synthetic polynucleotide
ggggatgcaggtggagctgt

SEQ ID NO: 5768 - DNA, 20 bp, Artificial Sequence
  Synthetic polynucleotide
tgtttttatcaacggcaggc

SEQ ID NO: 5769 - DNA, 20 bp, Artificial Sequence
  Synthetic polynucleotide
ggggagacggtgtggggaga

SEQ ID NO: 5770 - DNA, 20 bp, Artificial Sequence
  Synthetic polynucleotide
ccccccgaggagccaccccg

SEQ ID NO: 5771 - DNA, 20 bp, Artificial Sequence
  Synthetic polynucleotide
atcagggccagctggccagc

SEQ ID NO: 5772 - DNA, 20 bp, Artificial Sequence
  Synthetic polynucleotide
atgctcttctgcagagggag

SEQ ID NO: 5773 - DNA, 20 bp, Artificial Sequence
  Synthetic polynucleotide
ttgaggtagaaagggaacta

SEQ ID NO: 5774 - DNA, 20 bp, Artificial Sequence
  Synthetic polynucleotide
gtagatcttccaggtggagg

SEQ ID NO: 5775 - DNA, 20 bp, Artificial Sequence
  Synthetic polynucleotide
agtttcgctgccacttccga

SEQ ID NO: 5776 - DNA, 20 bp, Artificial Sequence
  Synthetic polynucleotide
ctaaggtatccctggatccc

SEQ ID NO: 5777 - DNA, 20 bp, Artificial Sequence
  Synthetic polynucleotide
agacggctaggtgctccaga

SEQ ID NO: 5778 - DNA, 20 bp, Artificial Sequence
  Synthetic polynucleotide
ggatgaagaggatgatgaag

SEQ ID NO: 5779 - DNA, 20 bp, Artificial Sequence
  Synthetic polynucleotide
tgtggagagaaactggtggg

SEQ ID NO: 5780 - DNA, 20 bp, Artificial Sequence
  Synthetic polynucleotide
cacaccgactcgctggagct

SEQ ID NO: 5781 - DNA, 20 bp, Artificial Sequence
  Synthetic polynucleotide
tccggcaggtgtcgtccggc

SEQ ID NO: 5782 - DNA, 20 bp, Artificial Sequence
  Synthetic polynucleotide
gatctctgctgctggtggaa

SEQ ID NO: 5783 - DNA, 20 bp, Artificial Sequence
  Synthetic polynucleotide
gcccgggaaggggcagggga

SEQ ID NO: 5784 - DNA, 20 bp, Artificial Sequence
  Synthetic polynucleotide
ggcccagcatacaggcctac

SEQ ID NO: 5785 - DNA, 20 bp, Artificial Sequence
  Synthetic polynucleotide
caatgaacttacgcttggct

SEQ ID NO: 5786 - DNA, 20 bp, Artificial Sequence
  Synthetic polynucleotide
tctgcacgctctgcaatcaa

SEQ ID NO: 5787 - DNA, 20 bp, Artificial Sequence
  Synthetic polynucleotide
cggcgcggtggcgcgggagg

SEQ ID NO: 5788 - DNA, 20 bp, Artificial Sequence
  Synthetic polynucleotide
cggcggcggggagccccggg

SEQ ID NO: 5789 - DNA, 20 bp, Artificial Sequence
  Synthetic polynucleotide
gacgacaagaagctggacgc

SEQ ID NO: 5790 - DNA, 20 bp, Artificial Sequence
  Synthetic polynucleotide
cagcggcggcgcagcagcag

SEQ ID NO: 5791 - DNA, 20 bp, Artificial Sequence
  Synthetic polynucleotide
ttgtccttgcagtcggggcg

SEQ ID NO: 5792 - DNA, 20 bp, Artificial Sequence
  Synthetic polynucleotide
aggtgttgaatggaattgaa

SEQ ID NO: 5793 - DNA, 20 bp, Artificial Sequence
  Synthetic polynucleotide
cggctggactcacggggtgg

SEQ ID NO: 5794 - DNA, 20 bp, Artificial Sequence
  Synthetic polynucleotide
cacttctaaactcctccccc

SEQ ID NO: 5795 - DNA, 20 bp, Artificial Sequence
  Synthetic polynucleotide
ggagccttcgatgcggaatg

SEQ ID NO: 5796 - DNA, 20 bp, Artificial Sequence
  Synthetic polynucleotide
tgataattaatatgaggatg

SEQ ID NO: 5797 - DNA, 20 bp, Artificial Sequence
  Synthetic polynucleotide
ggggccgggattggatggat

SEQ ID NO: 5798 - DNA, 20 bp, Artificial Sequence
  Synthetic polynucleotide
ataccggagccaatggtatc

SEQ ID NO: 5799 - DNA, 20 bp, Artificial Sequence
  Synthetic polynucleotide
agcacacaaaaatggaaaaa

SEQ ID NO: 5800 - DNA, 20 bp, Artificial Sequence
  Synthetic polynucleotide
gtctagatctcctcagtggg

SEQ ID NO: 5801 - DNA, 20 bp, Artificial Sequence
  Synthetic polynucleotide
cctcgcaggagtctgatgac

SEQ ID NO: 5802 - DNA, 20 bp, Artificial Sequence
  Synthetic polynucleotide
aacgggtcgccatcgacaac

SEQ ID NO: 5803 - DNA, 20 bp, Artificial Sequence
  Synthetic polynucleotide
tcgaactcccgcaccagacc

SEQ ID NO: 5804 - DNA, 20 bp, Artificial Sequence
  Synthetic polynucleotide
caaacttcggggggcggcgg

SEQ ID NO: 5805 - DNA, 20 bp, Artificial Sequence
  Synthetic polynucleotide
gcgtgggcacgggcagtgag

SEQ ID NO: 5806 - DNA, 20 bp, Artificial Sequence
  Synthetic polynucleotide
gttgtaaatgggggtgtaaa

SEQ ID NO: 5807 - DNA, 20 bp, Artificial Sequence
  Synthetic polynucleotide
ctcatagagtaacgagtaac

SEQ ID NO: 5808 - DNA, 20 bp, Artificial Sequence
  Synthetic polynucleotide
tcacggctcagacggcttca

SEQ ID NO: 5809 - DNA, 20 bp, Artificial Sequence
  Synthetic polynucleotide
ttagacgagcagctgcatgc

SEQ ID NO: 5810 - DNA, 20 bp, Artificial Sequence
  Synthetic polynucleotide
ggtgatcaaacgccccgccc

SEQ ID NO: 5811 - DNA, 20 bp, Artificial Sequence
  Synthetic polynucleotide
gtggtcggaggagacgtagg

SEQ ID NO: 5812 - DNA, 20 bp, Artificial Sequence
  Synthetic polynucleotide
agcaccaggcactggggctg

SEQ ID NO: 5813 - DNA, 20 bp, Artificial Sequence
  Synthetic polynucleotide
gagctggcgtttctgcgcag

SEQ ID NO: 5814 - DNA, 20 bp, Artificial Sequence
  Synthetic polynucleotide
ctggtagagctctgtcattt

SEQ ID NO: 5815 - DNA, 20 bp, Artificial Sequence
  Synthetic polynucleotide
atggtctccttggtagccct

SEQ ID NO: 5816 - DNA, 20 bp, Artificial Sequence
  Synthetic polynucleotide
ccacgtcaacaacggcaact

SEQ ID NO: 5817 - DNA, 20 bp, Artificial Sequence
  Synthetic polynucleotide
ggctaggtccaggtgcgtgc

SEQ ID NO: 5818 - DNA, 20 bp, Artificial Sequence
  Synthetic polynucleotide
tgtggctcctgcggctcctg

SEQ ID NO: 5819 - DNA, 20 bp, Artificial Sequence
  Synthetic polynucleotide
ctcttcctctgtgcgcccgc

SEQ ID NO: 5820 - DNA, 20 bp, Artificial Sequence
  Synthetic polynucleotide
gtgggggtgcggcggaggtg

SEQ ID NO: 5821 - DNA, 20 bp, Artificial Sequence
  Synthetic polynucleotide
gcagccaccaagagccggcc

SEQ ID NO: 5822 - DNA, 20 bp, Artificial Sequence
  Synthetic polynucleotide
acgaggccggcgatggccga

SEQ ID NO: 5823 - DNA, 20 bp, Artificial Sequence
  Synthetic polynucleotide
catggggctgctggcgctgc

SEQ ID NO: 5824 - DNA, 20 bp, Artificial Sequence
  Synthetic polynucleotide
cccaggccctgcagggcccc

SEQ ID NO: 5825 - DNA, 20 bp, Artificial Sequence
  Synthetic polynucleotide
ccacggagcggaaggtgtaa

SEQ ID NO: 5826 - DNA, 20 bp, Artificial Sequence
  Synthetic polynucleotide
agatttaaattccaaattcc

SEQ ID NO: 5827 - DNA, 20 bp, Artificial Sequence
  Synthetic polynucleotide
aagatagaaagggagaaaga

SEQ ID NO: 5828 - DNA, 20 bp, Artificial Sequence
  Synthetic polynucleotide
tcatcctctccatcgtgggt

SEQ ID NO: 5829 - DNA, 20 bp, Artificial Sequence
  Synthetic polynucleotide
aaaggttctgctagtgataa

SEQ ID NO: 5830 - DNA, 20 bp, Artificial Sequence
  Synthetic polynucleotide
gggatacctgacaggggagg

SEQ ID NO: 5831 - DNA, 20 bp, Artificial Sequence
  Synthetic polynucleotide
ggtcatgagcaacatggtca

SEQ ID NO: 5832 - DNA, 20 bp, Artificial Sequence
  Synthetic polynucleotide
cgtgggcctgtacacgtccg

SEQ ID NO: 5833 - DNA, 20 bp, Artificial Sequence
  Synthetic polynucleotide
aaactgtcaggaaaactgtc

SEQ ID NO: 5834 - DNA, 20 bp, Artificial Sequence
  Synthetic polynucleotide
ttgatgaaggagtgaggcgg

SEQ ID NO: 5835 - DNA, 20 bp, Artificial Sequence
  Synthetic polynucleotide
ctgcagaacattgggaacat

SEQ ID NO: 5836 - DNA, 20 bp, Artificial Sequence
  Synthetic polynucleotide
ccgggataccttggtatata

SEQ ID NO: 5837 - DNA, 20 bp, Artificial Sequence
  Synthetic polynucleotide
ccgggccgcggcagcggcgg

SEQ ID NO: 5838 - DNA, 20 bp, Artificial Sequence
  Synthetic polynucleotide
caaaaatggctgggtgtagt

SEQ ID NO: 5839 - DNA, 20 bp, Artificial Sequence
  Synthetic polynucleotide
cagaggcacttaactaactc

SEQ ID NO: 5840 - DNA, 20 bp, Artificial Sequence
  Synthetic polynucleotide
tgctgagttctaaggaagga

SEQ ID NO: 5841 - DNA, 20 bp, Artificial Sequence
  Synthetic polynucleotide
cactgcttgtggacaacaac

SEQ ID NO: 5842 - DNA, 20 bp, Artificial Sequence
  Synthetic polynucleotide
ggacggactggtcccccccc

SEQ ID NO: 5843 - DNA, 20 bp, Artificial Sequence
  Synthetic polynucleotide
ccttggtgcgtcatccatcc

SEQ ID NO: 5844 - DNA, 20 bp, Artificial Sequence
  Synthetic polynucleotide
aatgaactttccaggatagc

SEQ ID NO: 5845 - DNA, 20 bp, Artificial Sequence
  Synthetic polynucleotide
ggatgtcatctgtggatctg

SEQ ID NO: 5846 - DNA, 20 bp, Artificial Sequence
  Synthetic polynucleotide
ccctaacttagacttctttc

SEQ ID NO: 5847 - DNA, 20 bp, Artificial Sequence
  Synthetic polynucleotide
atgaagcccacagggactca

SEQ ID NO: 5848 - DNA, 20 bp, Artificial Sequence
  Synthetic polynucleotide
tgacaatggcctggggctga

SEQ ID NO: 5849 - DNA, 20 bp, Artificial Sequence
  Synthetic polynucleotide
acactcgcctgtgaagatga

SEQ ID NO: 5850 - DNA, 20 bp, Artificial Sequence
  Synthetic polynucleotide
ccagcagcagggcaacagcc

SEQ ID NO: 5851 - DNA, 20 bp, Artificial Sequence
  Synthetic polynucleotide
caaccacctccagcctggcc

SEQ ID NO: 5852 - DNA, 20 bp, Artificial Sequence
  Synthetic polynucleotide
atggaggggccggactggag

SEQ ID NO: 5853 - DNA, 20 bp, Artificial Sequence
  Synthetic polynucleotide
cgatggaggggccggactgg

SEQ ID NO: 5854 - DNA, 20 bp, Artificial Sequence
  Synthetic polynucleotide
cttgccctgggactccagcc

SEQ ID NO: 5855 - DNA, 20 bp, Artificial Sequence
  Synthetic polynucleotide
atcagaaggggtaatccaga

SEQ ID NO: 5856 - DNA, 20 bp, Artificial Sequence
  Synthetic polynucleotide
attaggtgggcttagatttg

SEQ ID NO: 5857 - DNA, 20 bp, Artificial Sequence
  Synthetic polynucleotide
agactgctcagggctactca

SEQ ID NO: 5858 - DNA, 20 bp, Artificial Sequence
  Synthetic polynucleotide
tgccgtggggcccagtcccg

SEQ ID NO: 5859 - DNA, 20 bp, Artificial Sequence
  Synthetic polynucleotide
gccacacgggccttgacgta

SEQ ID NO: 5860 - DNA, 20 bp, Artificial Sequence
  Synthetic polynucleotide
cgtcgccccggggccgcccc

SEQ ID NO: 5861 - DNA, 20 bp, Artificial Sequence
  Synthetic polynucleotide
ctcacggtgggccttcacgg

SEQ ID NO: 5862 - DNA, 20 bp, Artificial Sequence
  Synthetic polynucleotide
gacatcatgtgcggggatgc

SEQ ID NO: 5863 - DNA, 20 bp, Artificial Sequence
  Synthetic polynucleotide
tggcgatggtggcgagccgg

SEQ ID NO: 5864 - DNA, 20 bp, Artificial Sequence
  Synthetic polynucleotide
gttcatgatggctggcatga

SEQ ID NO: 5865 - DNA, 20 bp, Artificial Sequence
  Synthetic polynucleotide
agtgctggctgtgccagagc

SEQ ID NO: 5866 - DNA, 20 bp, Artificial Sequence
  Synthetic polynucleotide
gatgctggctgtgccagtgc

SEQ ID NO: 5867 - DNA, 20 bp, Artificial Sequence
  Synthetic polynucleotide
acgtcgccccggggccgccc

SEQ ID NO: 5868 - DNA, 20 bp, Artificial Sequence
  Synthetic polynucleotide
tccagcctggagtcccaggc

SEQ ID NO: 5869 - DNA, 20 bp, Artificial Sequence
  Synthetic polynucleotide
aacctgggcaagctggacct

SEQ ID NO: 5870 - DNA, 20 bp, Artificial Sequence
  Synthetic polynucleotide
tgctgcggacgccgggacgc

SEQ ID NO: 5871 - DNA, 20 bp, Artificial Sequence
  Synthetic polynucleotide
ggccgaggacttgccgcaga

SEQ ID NO: 5872 - DNA, 20 bp, Artificial Sequence
  Synthetic polynucleotide
aagctgaggccgaaaagctg

SEQ ID NO: 5873 - DNA, 20 bp, Artificial Sequence
  Synthetic polynucleotide
agacatcatgtgcggggatg

SEQ ID NO: 5874 - DNA, 20 bp, Artificial Sequence
  Synthetic polynucleotide
gcggctccgggactgggccc

SEQ ID NO: 5875 - DNA, 20 bp, Artificial Sequence
  Synthetic polynucleotide
accatggtggacggcaccct

SEQ ID NO: 5876 - DNA, 20 bp, Artificial Sequence
  Synthetic polynucleotide
cgcgtccgcgccatgggcca

SEQ ID NO: 5877 - DNA, 20 bp, Artificial Sequence
  Synthetic polynucleotide
ctggtactcctgggtctcct

SEQ ID NO: 5878 - DNA, 20 bp, Artificial Sequence
  Synthetic polynucleotide
ccaggggacccaggagaccc

SEQ ID NO: 5879 - DNA, 20 bp, Artificial Sequence
  Synthetic polynucleotide
tgaagacaaaaggaggatca

SEQ ID NO: 5880 - DNA, 20 bp, Artificial Sequence
  Synthetic polynucleotide
aggtgcggctgcagcaggtg

SEQ ID NO: 5881 - DNA, 20 bp, Artificial Sequence
  Synthetic polynucleotide
ttccagttacctccatggca

SEQ ID NO: 5882 - DNA, 20 bp, Artificial Sequence
  Synthetic polynucleotide
ctcacatggtggagagtgga

SEQ ID NO: 5883 - DNA, 20 bp, Artificial Sequence
  Synthetic polynucleotide
ctgccgtggggcccagtccc

SEQ ID NO: 5884 - DNA, 20 bp, Artificial Sequence
  Synthetic polynucleotide
tgtccttgcagtcggcagtc

SEQ ID NO: 5885 - DNA, 20 bp, Artificial Sequence
  Synthetic polynucleotide
gcttgggccggggcggtttg

SEQ ID NO: 5886 - DNA, 20 bp, Artificial Sequence
  Synthetic polynucleotide
cgccatggcgatgagcgcca

SEQ ID NO: 5887 - DNA, 20 bp, Artificial Sequence
  Synthetic polynucleotide
tctgccgtggggcccagtcc

SEQ ID NO: 5888 - DNA, 20 bp, Artificial Sequence
  Synthetic polynucleotide
tggggcaggcggcggtgcgg

SEQ ID NO: 5889 - DNA, 20 bp, Artificial Sequence
  Synthetic polynucleotide
gacggtgaagacggtgaaga

SEQ ID NO: 5890 - DNA, 20 bp, Artificial Sequence
  Synthetic polynucleotide
ccttcccagtgaggcaggca

SEQ ID NO: 5891 - DNA, 20 bp, Artificial Sequence
  Synthetic polynucleotide
agacagtgaggaggaagaag

SEQ ID NO: 5892 - DNA, 20 bp, Artificial Sequence
  Synthetic polynucleotide
aaaagccagggataaaagcc

SEQ ID NO: 5893 - DNA, 20 bp, Artificial Sequence
  Synthetic polynucleotide
gaactttgcagacgaggacg

SEQ ID NO: 5894 - DNA, 20 bp, Artificial Sequence
  Synthetic polynucleotide
tgtgggtgctgagggtgccg

SEQ ID NO: 5895 - DNA, 20 bp, Artificial Sequence
  Synthetic polynucleotide
gggccgggccgggcagggca

SEQ ID NO: 5896 - DNA, 20 bp, Artificial Sequence
  Synthetic polynucleotide
tgacgtgggctgggccgggc

SEQ ID NO: 5897 - DNA, 20 bp, Artificial Sequence
  Synthetic polynucleotide
aggctgtgcgggaaatgtgc

SEQ ID NO: 5898 - DNA, 20 bp, Artificial Sequence
  Synthetic polynucleotide
tcaccagtgtgggcttcgtg

SEQ ID NO: 5899 - DNA, 20 bp, Artificial Sequence
  Synthetic polynucleotide
actgcgctgagggcccgctg

SEQ ID NO: 5900 - DNA, 20 bp, Artificial Sequence
  Synthetic polynucleotide
ctgcgctgagggcccgctga

SEQ ID NO: 5901 - DNA, 20 bp, Artificial Sequence
  Synthetic polynucleotide
agtacactatcctggaatcc

SEQ ID NO: 5902 - DNA, 20 bp, Artificial Sequence
  Synthetic polynucleotide
cacggcagcgggccctcagc

SEQ ID NO: 5903 - DNA, 20 bp, Artificial Sequence
  Synthetic polynucleotide
atcagtgcgaggtcggcatg

SEQ ID NO: 5904 - DNA, 20 bp, Artificial Sequence
  Synthetic polynucleotide
gctggcagacggggccagac

SEQ ID NO: 5905 - DNA, 20 bp, Artificial Sequence
  Synthetic polynucleotide
ctgtagtcgtgggcagtcgt

SEQ ID NO: 5906 - DNA, 20 bp, Artificial Sequence
  Synthetic polynucleotide
ggtatgggcggggccagggc

SEQ ID NO: 5907 - DNA, 20 bp, Artificial Sequence
  Synthetic polynucleotide
gctgatcctgggccgcttct

SEQ ID NO: 5908 - DNA, 20 bp, Artificial Sequence
  Synthetic polynucleotide
ggcggcgcgggcctcccgcg

SEQ ID NO: 5909 - DNA, 20 bp, Artificial Sequence
  Synthetic polynucleotide
gggtcagcctggaggcctgg

SEQ ID NO: 5910 - DNA, 20 bp, Artificial Sequence
  Synthetic polynucleotide
ttgcttcaggcccttgcttc

SEQ ID NO: 5911 - DNA, 20 bp, Artificial Sequence
  Synthetic polynucleotide
ctggtccggcaggtgtcgtc

SEQ ID NO: 5912 - DNA, 20 bp, Artificial Sequence
  Synthetic polynucleotide
cccccaccctggccccgccc

SEQ ID NO: 5913 - DNA, 20 bp, Artificial Sequence
  Synthetic polynucleotide
gacatggggcaaccttctcg

SEQ ID NO: 5914 - DNA, 20 bp, Artificial Sequence
  Synthetic polynucleotide
ctgcgccgggaggcccgcgc

SEQ ID NO: 5915 - DNA, 20 bp, Artificial Sequence
  Synthetic polynucleotide
ccaagaccgggtctcaagac

SEQ ID NO: 5916 - DNA, 20 bp, Artificial Sequence
  Synthetic polynucleotide
gcacgtggcctaccggagac

SEQ ID NO: 5917 - DNA, 20 bp, Artificial Sequence
  Synthetic polynucleotide
catcagtggggcgctggagt

SEQ ID NO: 5918 - DNA, 20 bp, Artificial Sequence
  Synthetic polynucleotide
aaaatcgttttagggtttta

SEQ ID NO: 5919 - DNA, 20 bp, Artificial Sequence
  Synthetic polynucleotide
agggcagccaggacgccgcc

SEQ ID NO: 5920 - DNA, 20 bp, Artificial Sequence
  Synthetic polynucleotide
tcatcagtggggcgctggag

SEQ ID NO: 5921 - DNA, 20 bp, Artificial Sequence
  Synthetic polynucleotide
ggcggaactgggggcggaac

SEQ ID NO: 5922 - DNA, 20 bp, Artificial Sequence
  Synthetic polynucleotide
ctggcagacggggccagacg

SEQ ID NO: 5923 - DNA, 20 bp, Artificial Sequence
  Synthetic polynucleotide
gagtgttcatctgggaatct

SEQ ID NO: 5924 - DNA, 20 bp, Artificial Sequence
  Synthetic polynucleotide
cggtatgggcggggccaggg

SEQ ID NO: 5925 - DNA, 20 bp, Artificial Sequence
  Synthetic polynucleotide
agctcaaggtggagacaagg

SEQ ID NO: 5926 - DNA, 20 bp, Artificial Sequence
  Synthetic polynucleotide
cgcggtgcggtccgggactg

SEQ ID NO: 5927 - DNA, 20 bp, Artificial Sequence
  Synthetic polynucleotide
ggtggcctttgcggcctctg

SEQ ID NO: 5928 - DNA, 20 bp, Artificial Sequence
  Synthetic polynucleotide
actggatcacagggatcaca

SEQ ID NO: 5929 - DNA, 20 bp, Artificial Sequence
  Synthetic polynucleotide
catgaagggctgggaggcaa

SEQ ID NO: 5930 - DNA, 20 bp, Artificial Sequence
  Synthetic polynucleotide
gaaaagggtccagatggaaa

SEQ ID NO: 5931 - DNA, 20 bp, Artificial Sequence
  Synthetic polynucleotide
ggccccggggcgacggcccc

SEQ ID NO: 5932 - DNA, 20 bp, Artificial Sequence
  Synthetic polynucleotide
ctcggcggggaggtgctcgg

SEQ ID NO: 5933 - DNA, 20 bp, Artificial Sequence
  Synthetic polynucleotide
gcggtccgggactgcggtcc

SEQ ID NO: 5934 - DNA, 20 bp, Artificial Sequence
  Synthetic polynucleotide
gagatgagaaggggaggaga

SEQ ID NO: 5935 - DNA, 20 bp, Artificial Sequence
  Synthetic polynucleotide
gctgggatgctgggccccgc

SEQ ID NO: 5936 - DNA, 20 bp, Artificial Sequence
  Synthetic polynucleotide
aaccggggcactgcagctac

SEQ ID NO: 5937 - DNA, 20 bp, Artificial Sequence
  Synthetic polynucleotide
gatgttggtacagccaacct

SEQ ID NO: 5938 - DNA, 20 bp, Artificial Sequence
  Synthetic polynucleotide
cagatggcctccaggcctcc

SEQ ID NO: 5939 - DNA, 20 bp, Artificial Sequence
  Synthetic polynucleotide
ggtgggggtgcggcggaggt

SEQ ID NO: 5940 - DNA, 20 bp, Artificial Sequence
  Synthetic polynucleotide
cgggggcttctttagcccgg

SEQ ID NO: 5941 - DNA, 20 bp, Artificial Sequence
  Synthetic polynucleotide
agcagctgacagagggttag

SEQ ID NO: 5942 - DNA, 20 bp, Artificial Sequence
  Synthetic polynucleotide
ggaccgggagcaccaggacc

SEQ ID NO: 5943 - DNA, 20 bp, Artificial Sequence
  Synthetic polynucleotide
cagatggccagctggccagc

SEQ ID NO: 5944 - DNA, 20 bp, Artificial Sequence
  Synthetic polynucleotide
gcggaactgggggcggaact

SEQ ID NO: 5945 - DNA, 20 bp, Artificial Sequence
  Synthetic polynucleotide
gggtgggggtgcggcggagg

SEQ ID NO: 5946 - DNA, 20 bp, Artificial Sequence
  Synthetic polynucleotide
atgcttccaaggccattcca

SEQ ID NO: 5947 - DNA, 20 bp, Artificial Sequence
  Synthetic polynucleotide
tgggggtgcggcggaggtgg

SEQ ID NO: 5948 - DNA, 20 bp, Artificial Sequence
  Synthetic polynucleotide
ccctgctgctggccagctgc

SEQ ID NO: 5949 - DNA, 20 bp, Artificial Sequence
  Synthetic polynucleotide
tggttgggatggggctggat

SEQ ID NO: 5950 - DNA, 20 bp, Artificial Sequence
  Synthetic polynucleotide
aggcgggggtgcggccgagg

SEQ ID NO: 5951 - DNA, 20 bp, Artificial Sequence
  Synthetic polynucleotide
gagaaggggaggagaagggg

SEQ ID NO: 5952 - DNA, 20 bp, Artificial Sequence
  Synthetic polynucleotide
gcaaggatgccttcagagca

SEQ ID NO: 5953 - DNA, 20 bp, Artificial Sequence
  Synthetic polynucleotide
gctgaaggggaaggctcgaa

SEQ ID NO: 5954 - DNA, 20 bp, Artificial Sequence
  Synthetic polynucleotide
cgaaggcctgtgggtgctgt

SEQ ID NO: 5955 - DNA, 20 bp, Artificial Sequence
  Synthetic polynucleotide
gcacggctcaggtgccagca

SEQ ID NO: 5956 - DNA, 20 bp, Artificial Sequence
  Synthetic polynucleotide
tccgggctaaagaagccccc

SEQ ID NO: 5957 - DNA, 20 bp, Artificial Sequence
  Synthetic polynucleotide
agtcaggtggctcctcgggg

SEQ ID NO: 5958 - DNA, 20 bp, Artificial Sequence
  Synthetic polynucleotide
gcgggggcttctttagcccg

SEQ ID NO: 5959 - DNA, 20 bp, Artificial Sequence
  Synthetic polynucleotide
catctggtggaatggggccc

SEQ ID NO: 5960 - DNA, 20 bp, Artificial Sequence
  Synthetic polynucleotide
tgctgatcctgggccgcttc

SEQ ID NO: 5961 - DNA, 20 bp, Artificial Sequence
  Synthetic polynucleotide
gcccgggaaggggcatggga

SEQ ID NO: 5962 - DNA, 20 bp, Artificial Sequence
  Synthetic polynucleotide
agcagaccagggccccacca

SEQ ID NO: 5963 - DNA, 20 bp, Artificial Sequence
  Synthetic polynucleotide
ttccctttgaggatccagat

SEQ ID NO: 5964 - DNA, 20 bp, Artificial Sequence
  Synthetic polynucleotide
gatgagaaggggaggagaag

SEQ ID NO: 5965 - DNA, 20 bp, Artificial Sequence
  Synthetic polynucleotide
ggcatcccggggccctggtg

SEQ ID NO: 5966 - DNA, 20 bp, Artificial Sequence
  Synthetic polynucleotide
ggcccgggaggcgaaccccc

SEQ ID NO: 5967 - DNA, 20 bp, Artificial Sequence
  Synthetic polynucleotide
aaacgggtcgccatcgacaa

SEQ ID NO: 5968 - DNA, 20 bp, Artificial Sequence
  Synthetic polynucleotide
gtgggcctgtacacgtccgt

SEQ ID NO: 5969 - DNA, 20 bp, Artificial Sequence
  Synthetic polynucleotide
gaatggaccagccccgggaa

SEQ ID NO: 5970 - DNA, 20 bp, Artificial Sequence
  Synthetic polynucleotide
gcggtgcatgggctgcgcat

SEQ ID NO: 5971 - DNA, 20 bp, Artificial Sequence
  Synthetic polynucleotide
gatggttttggtggaggaag

SEQ ID NO: 5972 - DNA, 20 bp, Artificial Sequence
  Synthetic polynucleotide
cgcgggcgtcctgctcgccg

SEQ ID NO: 5973 - DNA, 20 bp, Artificial Sequence
  Synthetic polynucleotide
gggcggcggccggaagggcg

SEQ ID NO: 5974 - DNA, 20 bp, Artificial Sequence
  Synthetic polynucleotide
atatcagtctgtgggactgt

SEQ ID NO: 5975 - DNA, 20 bp, Artificial Sequence
  Synthetic polynucleotide
cggcgggcgcagccggtcgg

SEQ ID NO: 5976 - DNA, 20 bp, Artificial Sequence
  Synthetic polynucleotide
cctgcgccgggaggcccgcg

SEQ ID NO: 5977 - DNA, 20 bp, Artificial Sequence
  Synthetic polynucleotide
aaagggccttcctgaggaaa

SEQ ID NO: 5978 - DNA, 20 bp, Artificial Sequence
  Synthetic polynucleotide
ctcaggtgccagcacggctc

SEQ ID NO: 5979 - DNA, 20 bp, Artificial Sequence
  Synthetic polynucleotide
tgacggaacttgcgctccag

SEQ ID NO: 5980 - DNA, 20 bp, Artificial Sequence
  Synthetic polynucleotide
aggcgggggtgcggccgggg

SEQ ID NO: 5981 - DNA, 20 bp, Artificial Sequence
  Synthetic polynucleotide
gcgggggtgcggccggggcg

SEQ ID NO: 5982 - DNA, 20 bp, Artificial Sequence
  Synthetic polynucleotide
ggcgggggtgcggccgaggc

SEQ ID NO: 5983 - DNA, 20 bp, Artificial Sequence
  Synthetic polynucleotide
ccgggcagggccacacgcgc

SEQ ID NO: 5984 - DNA, 20 bp, Artificial Sequence
  Synthetic polynucleotide
agggggcggaggcctggcaa

SEQ ID NO: 5985 - DNA, 20 bp, Artificial Sequence
  Synthetic polynucleotide
ttgtaaatgggggtgtaaat

SEQ ID NO: 5986 - DNA, 20 bp, Artificial Sequence
  Synthetic polynucleotide
cgggggcatctatgtctgcg

SEQ ID NO: 5987 - DNA, 20 bp, Artificial Sequence
  Synthetic polynucleotide
aagagggccccattccacca

SEQ ID NO: 5988 - DNA, 20 bp, Artificial Sequence
  Synthetic polynucleotide
tgggggtgcggcggaggcgg

SEQ ID NO: 5989 - DNA, 20 bp, Artificial Sequence
  Synthetic polynucleotide
gtgcggcgggaggaggcggc

SEQ ID NO: 5990 - DNA, 20 bp, Artificial Sequence
  Synthetic polynucleotide
gccccggggcgacggccccg

SEQ ID NO: 5991 - DNA, 20 bp, Artificial Sequence
  Synthetic polynucleotide
cgggcagggccacacgcgcc

SEQ ID NO: 5992 - DNA, 20 bp, Artificial Sequence
  Synthetic polynucleotide
atgggagcagcaggtgtcga

SEQ ID NO: 5993 - DNA, 20 bp, Artificial Sequence
  Synthetic polynucleotide
tcattatagtcaagggcata

SEQ ID NO: 5994 - DNA, 20 bp, Artificial Sequence
  Synthetic polynucleotide
agagctcctcggacgctcct

SEQ ID NO: 5995 - DNA, 20 bp, Artificial Sequence
  Synthetic polynucleotide
cgggagacggggctggagac

SEQ ID NO: 5996 - DNA, 20 bp, Artificial Sequence
  Synthetic polynucleotide
gccgccggcccgcgggcccg

SEQ ID NO: 5997 - DNA, 20 bp, Artificial Sequence
  Synthetic polynucleotide
ggttgggatggggctggatg

SEQ ID NO: 5998 - DNA, 20 bp, Artificial Sequence
  Synthetic polynucleotide
actgctcgggccgcgggccg

SEQ ID NO: 5999 - DNA, 20 bp, Artificial Sequence
  Synthetic polynucleotide
ggaccccggggcaccgggag

SEQ ID NO: 6000 - DNA, 20 bp, Artificial Sequence
  Synthetic polynucleotide
cgctgaaggggaaggctcga

SEQ ID NO: 6001 - DNA, 20 bp, Artificial Sequence
  Synthetic polynucleotide
cggcgggaggaggcggcggg

SEQ ID NO: 6002 - DNA, 20 bp, Artificial Sequence
  Synthetic polynucleotide
tccctctacgcctccgcctc

SEQ ID NO: 6003 - DNA, 20 bp, Artificial Sequence
  Synthetic polynucleotide
aaccacctccagcctggcct

SEQ ID NO: 6004 - DNA, 20 bp, Artificial Sequence
  Synthetic polynucleotide
gctggagatctcggaggcat

SEQ ID NO: 6005 - DNA, 20 bp, Artificial Sequence
  Synthetic polynucleotide
atggatcttacagggttaca

SEQ ID NO: 6006 - DNA, 20 bp, Artificial Sequence
  Synthetic polynucleotide
cgcaaaggggcggacgctga

SEQ ID NO: 6007 - DNA, 20 bp, Artificial Sequence
  Synthetic polynucleotide
gaaggggaaattgcacaagc

SEQ ID NO: 6008 - DNA, 20 bp, Artificial Sequence
  Synthetic polynucleotide
ccgggaaggggcatgggaag

SEQ ID NO: 6009 - DNA, 20 bp, Artificial Sequence
  Synthetic polynucleotide
ctgttctgaaggcaggtgca

SEQ ID NO: 6010 - DNA, 20 bp, Artificial Sequence
  Synthetic polynucleotide
ttggggtgctccgcctggct

SEQ ID NO: 6011 - DNA, 20 bp, Artificial Sequence
  Synthetic polynucleotide
tccgagcggcggctccgggg

SEQ ID NO: 6012 - DNA, 20 bp, Artificial Sequence
  Synthetic polynucleotide
cccggggcccgcgggcccgc

SEQ ID NO: 6013 - DNA, 20 bp, Artificial Sequence
  Synthetic polynucleotide
cccggcggcacacggcccgg

SEQ ID NO: 6014 - DNA, 20 bp, Artificial Sequence
  Synthetic polynucleotide
atctgcacgcggccgccgcg

SEQ ID NO: 6015 - DNA, 20 bp, Artificial Sequence
  Synthetic polynucleotide
gcgggcgtcctgctcgccgc

SEQ ID NO: 6016 - DNA, 20 bp, Artificial Sequence
  Synthetic polynucleotide
aggcgcagcagggccgcagc

SEQ ID NO: 6017 - DNA, 20 bp, Artificial Sequence
  Synthetic polynucleotide
acagcagccgcaggagccgc

SEQ ID NO: 6018 - DNA, 20 bp, Artificial Sequence
  Synthetic polynucleotide
aatggcacctggccccaaaa

SEQ ID NO: 6019 - DNA, 20 bp, Artificial Sequence
  Synthetic polynucleotide
cccgggaaggggcaggggaa

SEQ ID NO: 6020 - DNA, 20 bp, Artificial Sequence
  Synthetic polynucleotide
ttgctgcagatccgtgggcg

SEQ ID NO: 6021 - DNA, 20 bp, Artificial Sequence
  Synthetic polynucleotide
gagaggagctggacttgctc

SEQ ID NO: 6022 - DNA, 20 bp, Artificial Sequence
  Synthetic polynucleotide
ggaggggctggtccattccc

SEQ ID NO: 6023 - DNA, 20 bp, Artificial Sequence
  Synthetic polynucleotide
gtgctcactctgccaggcca

SEQ ID NO: 6024 - DNA, 20 bp, Artificial Sequence
  Synthetic polynucleotide
ggcgcagcagggccgcagca

SEQ ID NO: 6025 - DNA, 20 bp, Artificial Sequence
  Synthetic polynucleotide
ggggcggtttggggcggttt

SEQ ID NO: 6026 - DNA, 20 bp, Artificial Sequence
  Synthetic polynucleotide
ccgcgggagcgagggagcga

SEQ ID NO: 6027 - DNA, 20 bp, Artificial Sequence
  Synthetic polynucleotide
aagggctgggaggcaagggc

SEQ ID NO: 6028 - DNA, 20 bp, Artificial Sequence
  Synthetic polynucleotide
gaccccggggcaccgggagc

SEQ ID NO: 6029 - DNA, 20 bp, Artificial Sequence
  Synthetic polynucleotide
acccggggcccgcgggcccg

SEQ ID NO: 6030 - DNA, 20 bp, Artificial Sequence
  Synthetic polynucleotide
tgtaaatgggggtgtaaatg

SEQ ID NO: 6031 - DNA, 20 bp, Artificial Sequence
  Synthetic polynucleotide
ttctgaaggcaggtgaaggc

SEQ ID NO: 6032 - DNA, 20 bp, Artificial Sequence
  Synthetic polynucleotide
gggcaaggaggtggggttgt

SEQ ID NO: 6033 - DNA, 20 bp, Artificial Sequence
  Synthetic polynucleotide
aaggtgcaggtgggtgcagg

SEQ ID NO: 6034 - DNA, 20 bp, Artificial Sequence
  Synthetic polynucleotide
cggcgggctcgggctgcggc

SEQ ID NO: 6035 - DNA, 20 bp, Artificial Sequence
  Synthetic polynucleotide
ggcagccggcggaccagagg

SEQ ID NO: 6036 - DNA, 20 bp, Artificial Sequence
  Synthetic polynucleotide
acgggggcatctatgtctgc

SEQ ID NO: 6037 - DNA, 20 bp, Artificial Sequence
  Synthetic polynucleotide
acccgcggggagacggtgtg

SEQ ID NO: 6038 - DNA, 20 bp, Artificial Sequence
  Synthetic polynucleotide
cctatgcaggtgtccaacgg

SEQ ID NO: 6039 - DNA, 20 bp, Artificial Sequence
  Synthetic polynucleotide
gtgctggaaaagggtccaga

SEQ ID NO: 6040 - DNA, 20 bp, Artificial Sequence
  Synthetic polynucleotide
atgggcatgcagggcatgca

SEQ ID NO: 6041 - DNA, 20 bp, Artificial Sequence
  Synthetic polynucleotide
tcggcggggaggtgctcggc

SEQ ID NO: 6042 - DNA, 20 bp, Artificial Sequence
  Synthetic polynucleotide
tggggtgctccgcctggctt

SEQ ID NO: 6043 - DNA, 20 bp, Artificial Sequence
  Synthetic polynucleotide
gggcacatctgggtgcatct

SEQ ID NO: 6044 - DNA, 20 bp, Artificial Sequence
  Synthetic polynucleotide
ctttgcttccagggacttcc

SEQ ID NO: 6045 - DNA, 20 bp, Artificial Sequence
  Synthetic polynucleotide
cgcggggccccggggccccg

SEQ ID NO: 6046 - DNA, 20 bp, Artificial Sequence
  Synthetic polynucleotide
gaggtgggggctggggcgtg

SEQ ID NO: 6047 - DNA, 20 bp, Artificial Sequence
  Synthetic polynucleotide
cgcgcctggccccggggccc

SEQ ID NO: 6048 - DNA, 20 bp, Artificial Sequence
  Synthetic polynucleotide
ggacatggggcaaccttctc

SEQ ID NO: 6049 - DNA, 20 bp, Artificial Sequence
  Synthetic polynucleotide
cgggaggcgaaccccccggg

SEQ ID NO: 6050 - DNA, 20 bp, Artificial Sequence
  Synthetic polynucleotide
tgggggtcttcctttgcctg

SEQ ID NO: 6051 - DNA, 20 bp, Artificial Sequence
  Synthetic polynucleotide
gggcatcccggggccctggt

SEQ ID NO: 6052 - DNA, 20 bp, Artificial Sequence
  Synthetic polynucleotide
ggaggtgggggctggggcgt

SEQ ID NO: 6053 - DNA, 20 bp, Artificial Sequence
  Synthetic polynucleotide
ggggccctgggggaagcctg

SEQ ID NO: 6054 - DNA, 20 bp, Artificial Sequence
  Synthetic polynucleotide
ggcccggggaccaggggacc

SEQ ID NO: 6055 - DNA, 20 bp, Artificial Sequence
  Synthetic polynucleotide
cggggctggcgcggctggcg

SEQ ID NO: 6056 - DNA, 20 bp, Artificial Sequence
  Synthetic polynucleotide
cgcctggccccggggccccg

SEQ ID NO: 6057 - DNA, 20 bp, Artificial Sequence
  Synthetic polynucleotide
acagaaaaaagagggaaaga

SEQ ID NO: 6058 - DNA, 20 bp, Artificial Sequence
  Synthetic polynucleotide
cagggtgctcacggccatgc

SEQ ID NO: 6059 - DNA, 20 bp, Artificial Sequence
  Synthetic polynucleotide
tggctgggagagtccgacgt

SEQ ID NO: 6060 - DNA, 20 bp, Artificial Sequence
  Synthetic polynucleotide
ctgctggttccatgtgctgc

SEQ ID NO: 6061 - DNA, 20 bp, Artificial Sequence
  Synthetic polynucleotide
cccgccttgggggcgaggcg

SEQ ID NO: 6062 - DNA, 20 bp, Artificial Sequence
  Synthetic polynucleotide
cgtccgcagcccgcggcccg

SEQ ID NO: 6063 - DNA, 20 bp, Artificial Sequence
  Synthetic polynucleotide
ctggtgctgaagcctcctgc

SEQ ID NO: 6064 - DNA, 20 bp, Artificial Sequence
  Synthetic polynucleotide
caggtggccgtcgaggaccg

SEQ ID NO: 6065 - DNA, 20 bp, Artificial Sequence
  Synthetic polynucleotide
tagaggtcgatggccccgtc

SEQ ID NO: 6066 - DNA, 20 bp, Artificial Sequence
  Synthetic polynucleotide
tggctgcgctgggctgcgct

SEQ ID NO: 6067 - DNA, 20 bp, Artificial Sequence
  Synthetic polynucleotide
gctggtcctgctggtcctgc

SEQ ID NO: 6068 - DNA, 20 bp, Artificial Sequence
  Synthetic polynucleotide
cggaggcgggggtgcggccg

SEQ ID NO: 6069 - DNA, 20 bp, Artificial Sequence
  Synthetic polynucleotide
cccccaggaggtgaggttgc

SEQ ID NO: 6070 - DNA, 20 bp, Artificial Sequence
  Synthetic polynucleotide
ggggcggggctgggctgggc

SEQ ID NO: 6071 - DNA, 20 bp, Artificial Sequence
  Synthetic polynucleotide
gcgcctggccccggggcccc

SEQ ID NO: 6072 - DNA, 20 bp, Artificial Sequence
  Synthetic polynucleotide
gggctgtgggcagtgggcag

SEQ ID NO: 6073 - DNA, 20 bp, Artificial Sequence
  Synthetic polynucleotide
gcaggaccaacaggaccaac

SEQ ID NO: 6074 - DNA, 20 bp, Artificial Sequence
  Synthetic polynucleotide
gggtggagggtggaacgtgg

SEQ ID NO: 6075 - DNA, 20 bp, Artificial Sequence
  Synthetic polynucleotide
gggaggggctggtccattcc

SEQ ID NO: 6076 - DNA, 20 bp, Artificial Sequence
  Synthetic polynucleotide
gctgccttcgggccgccttc

SEQ ID NO: 6077 - DNA, 20 bp, Artificial Sequence
  Synthetic polynucleotide
cttcgtgggcaaggtgtggc

SEQ ID NO: 6078 - DNA, 20 bp, Artificial Sequence
  Synthetic polynucleotide
gtttcaagtggggcccagcg

SEQ ID NO: 6079 - DNA, 20 bp, Artificial Sequence
  Synthetic polynucleotide
caggaggcttcagcaccagc

SEQ ID NO: 6080 - DNA, 20 bp, Artificial Sequence
  Synthetic polynucleotide
gaaggccggccggtcggcga

SEQ ID NO: 6081 - DNA, 20 bp, Artificial Sequence
  Synthetic polynucleotide
gcgcaaaggggcggacgctg

SEQ ID NO: 6082 - DNA, 20 bp, Artificial Sequence
  Synthetic polynucleotide
acgcggtggaggcagggtgg

SEQ ID NO: 6083 - DNA, 20 bp, Artificial Sequence
  Synthetic polynucleotide
acaggtggcggtgttgtacg

SEQ ID NO: 6084 - DNA, 20 bp, Artificial Sequence
  Synthetic polynucleotide
ctgcggtatgggcggggcca

SEQ ID NO: 6085 - DNA, 20 bp, Artificial Sequence
  Synthetic polynucleotide
aggaggagatggaggccggg

SEQ ID NO: 6086 - DNA, 20 bp, Artificial Sequence
  Synthetic polynucleotide
gcagcggacctcgggagcag

SEQ ID NO: 6087 - DNA, 20 bp, Artificial Sequence
  Synthetic polynucleotide
aagggtcgaggtaagggaaa

SEQ ID NO: 6088 - DNA, 20 bp, Artificial Sequence
  Synthetic polynucleotide
acagggtgctcacggccatg

SEQ ID NO: 6089 - DNA, 20 bp, Artificial Sequence
  Synthetic polynucleotide
gggggtcttcctttgcctgg

SEQ ID NO: 6090 - DNA, 20 bp, Artificial Sequence
  Synthetic polynucleotide
cacccgcggggagacggtgt

SEQ ID NO: 6091 - DNA, 20 bp, Artificial Sequence
  Synthetic polynucleotide
tgggagagtccgacgttggc

SEQ ID NO: 6092 - DNA, 20 bp, Artificial Sequence
  Synthetic polynucleotide
aggtgggggctggggcgtgg

SEQ ID NO: 6093 - DNA, 20 bp, Artificial Sequence
  Synthetic polynucleotide
cgcaagatggaggtgggagg

SEQ ID NO: 6094 - DNA, 20 bp, Artificial Sequence
  Synthetic polynucleotide
tcacccgcggggagacggtg

SEQ ID NO: 6095 - DNA, 20 bp, Artificial Sequence
  Synthetic polynucleotide
ccgggaaggggcaggggaag

SEQ ID NO: 6096 - DNA, 20 bp, Artificial Sequence
  Synthetic polynucleotide
ggtcggcggccccggggcga

SEQ ID NO: 6097 - DNA, 20 bp, Artificial Sequence
  Synthetic polynucleotide
ttgggccaacagcaccagca

SEQ ID NO: 6098 - DNA, 20 bp, Artificial Sequence
  Synthetic polynucleotide
agctggggctgcgttgcagc

SEQ ID NO: 6099 - DNA, 20 bp, Artificial Sequence
  Synthetic polynucleotide
tagcacaagaggccttaaaa

SEQ ID NO: 6100 - DNA, 20 bp, Artificial Sequence
  Synthetic polynucleotide
ttggggccctgggggaagcc

SEQ ID NO: 6101 - DNA, 20 bp, Artificial Sequence
  Synthetic polynucleotide
ggggcagccgggcacgaagg

SEQ ID NO: 6102 - DNA, 20 bp, Artificial Sequence
  Synthetic polynucleotide
tggacatggggcaaccttct

SEQ ID NO: 6103 - DNA, 20 bp, Artificial Sequence
  Synthetic polynucleotide
tcggctggtgctgcctcggc

SEQ ID NO: 6104 - DNA, 20 bp, Artificial Sequence
  Synthetic polynucleotide
tagcggagggcgcggggcgc

SEQ ID NO: 6105 - DNA, 20 bp, Artificial Sequence
  Synthetic polynucleotide
ttgccgggttcgcctcccgg

SEQ ID NO: 6106 - DNA, 20 bp, Artificial Sequence
  Synthetic polynucleotide
agggctgggaggcaagggct

SEQ ID NO: 6107 - DNA, 20 bp, Artificial Sequence
  Synthetic polynucleotide
cgccggccgcacccccgcct

SEQ ID NO: 6108 - DNA, 20 bp, Artificial Sequence
  Synthetic polynucleotide
agggaggcccggatgctgaa

SEQ ID NO: 6109 - DNA, 20 bp, Artificial Sequence
  Synthetic polynucleotide
tgagcgagcgcaggcggcgc

SEQ ID NO: 6110 - DNA, 20 bp, Artificial Sequence
  Synthetic polynucleotide
gggcagtgctggcggcgtcc

SEQ ID NO: 6111 - DNA, 20 bp, Artificial Sequence
  Synthetic polynucleotide
cggcggggaggtgctcggcg

SEQ ID NO: 6112 - DNA, 20 bp, Artificial Sequence
  Synthetic polynucleotide
gggccctgggggaagcctgg

SEQ ID NO: 6113 - DNA, 20 bp, Artificial Sequence
  Synthetic polynucleotide
aggcgggtcgggggcgggcg

SEQ ID NO: 6114 - DNA, 20 bp, Artificial Sequence
  Synthetic polynucleotide
gggggccgcggcgcgggggc

SEQ ID NO: 6115 - DNA, 20 bp, Artificial Sequence
  Synthetic polynucleotide
gtagcggagggcgcggggcg

SEQ ID NO: 6116 - DNA, 20 bp, Artificial Sequence
  Synthetic polynucleotide
tggaaggccaggcaggtgga

SEQ ID NO: 6117 - DNA, 55 bp, Artificial Sequence
  Synthetic polynucleotide
ctccattcgtgtcgccgaccgcggcggcggcggcggcggcggcggcggcgcccaa

SEQ ID NO: 6118 - DNA, 55 bp, Artificial Sequence
  Synthetic polynucleotide
ctagtaccttgcgtagtactgaggaggaggaggaggaggaggaggaggcatccgg

SEQ ID NO: 6119 - DNA, 55 bp, Artificial Sequence
  Synthetic polynucleotide
gtagtcagcttgcctactcgggggcggggcggggcggggcggggccgcagactca

SEQ ID NO: 6120 - DNA, 55 bp, Artificial Sequence
  Synthetic polynucleotide
gcacgtaccctgagtccccgcggcgcggcgcggcgcggcgcggcaggagagtaag

SEQ ID NO: 6121 - DNA, 55 bp, Artificial Sequence
  Synthetic polynucleotide
cgcgcgcgcgcgcgcgcgcgcgcgcgcgcgtggatgaggccactagggagtctat

SEQ ID NO: 6122 - DNA, 55 bp, Artificial Sequence
  Synthetic polynucleotide
cagcagcagcagcagcagcagcagcagcagtggaccatcgatgcatgctcctaca

SEQ ID NO: 6123 - DNA, 55 bp, Artificial Sequence
  Synthetic polynucleotide
gaagaagaagaagaagaagaagaagaagaatgggtctttttcgttaataagtaac

SEQ ID NO: 6124 - DNA, 55 bp, Artificial Sequence
  Synthetic polynucleotide
ctagcgagcgagcgagcgagcgagcgagcgtggactcatcctccgcgttattgtg

SEQ ID NO: 6125 - DNA, 55 bp, Artificial Sequence
  Synthetic polynucleotide
caaatgggtagctaatttcgcgcgcgcgcgtggctatccacctggtgaaaactgt

SEQ ID NO: 6126 - DNA, 55 bp, Artificial Sequence
  Synthetic polynucleotide
tgttgccctttttcctttcagcagcagcagtggcatgtatgctgtcctggtttct

SEQ ID NO: 6127 - DNA, 55 bp, Artificial Sequence
  Synthetic polynucleotide
tcaacaacggggacctttgaagaagaagaatggcgatcttccctgtatgacgcgc

SEQ ID NO: 6128 - DNA, 55 bp, Artificial Sequence
  Synthetic polynucleotide
caacacgtactagtttttcggcggcggcggtggatttggcgaggaccatcatcaa

SEQ ID NO: 6129 - DNA, 55 bp, Artificial Sequence
  Synthetic polynucleotide
atgtgcagcctcgattttaggaggaggaggtggcgaactcatagtgggaaatgag

SEQ ID NO: 6130 - DNA, 55 bp, Artificial Sequence
  Synthetic polynucleotide
gcttacatctatacttttagcgagcgagcgtggccgtgcggacagagttaaataa

SEQ ID NO: 6131 - DNA, 55 bp, Artificial Sequence
  Synthetic polynucleotide
agcaaagtttcgcgttttttggggcggggctggtgtcaacagagcattttatcct

SEQ ID NO: 6132 - DNA, 55 bp, Artificial Sequence
  Synthetic polynucleotide
aacaagactaatcaatttttcgcggcgcggtggccgcaactacagcatcgccgcg

SEQ ID NO: 6133 - DNA, 55 bp, Artificial Sequence
  Synthetic polynucleotide
tagtttctagcacagcgctggtgtggcgtgtggctgaaggcatacgtaattctga

SEQ ID NO: 6134 - DNA, 55 bp, Artificial Sequence
  Synthetic polynucleotide
tacgactcccatgccgttgcgacggcccgacggcctactctcgcgccaataagcc

SEQ ID NO: 6135 - DNA, 55 bp, Artificial Sequence
  Synthetic polynucleotide
agaggaggctggattccagatggggttgatggggtttcagcgagtgggccgctgt

SEQ ID NO: 6136 - DNA, 55 bp, Artificial Sequence
  Synthetic polynucleotide
agcgctcatataacgatatggggggttatggggggttgaattgcttcagcacgat

SEQ ID NO: 6137 - DNA, 55 bp, Artificial Sequence
  Synthetic polynucleotide
gaaagttttacgccattaaggggtacctaaggggtaccgttacgcatacggagag

SEQ ID NO: 6138 - DNA, 55 bp, Artificial Sequence
  Synthetic polynucleotide
acaatacaatccgcgctgtggacggccctgtggacggcctcgaccccactactga

SEQ ID NO: 6139 - DNA, 55 bp, Artificial Sequence
  Synthetic polynucleotide
caagtgattggcctggttggggtgtacggttggggtgtacccatagcacctgtcg

SEQ ID NO: 6140 - DNA, 55 bp, Artificial Sequence
  Synthetic polynucleotide
cacgtgcgcagattacggggcaatgagtacggggcaatgagttagaccccaatga

SEQ ID NO: 6141 - DNA, 55 bp, Artificial Sequence
  Synthetic polynucleotide
ctttctccgaagtgcaggttacattcgtgcaggttacattcggcgtcctttaaga

SEQ ID NO: 6142 - DNA, 55 bp, Artificial Sequence
  Synthetic polynucleotide
cggagcccacttgtgggccagaccttttgtgggccagacctttatccgccagcga

SEQ ID NO: 6143 - DNA, 55 bp, Artificial Sequence
  Synthetic polynucleotide
gcgataaatatgacggctcatcctgtatgacggctcatcctgtatcaactgtccc

SEQ ID NO: 6144 - DNA, 55 bp, Artificial Sequence
  Synthetic polynucleotide
tattcatcttctcggctatatacggagtctcggctatatacggagcgtattctac

SEQ ID NO: 6145 - DNA, 55 bp, Artificial Sequence
  Synthetic polynucleotide
ttcgccgtcacgggaagcccgacataccacgggaagcccgacatactacgcaagc

SEQ ID NO: 6146 - DNA, 55 bp, Artificial Sequence
  Synthetic polynucleotide
ggagtagcactggacgttttttgcgggcactggacgttttttgcgggggctgcat

SEQ ID NO: 6147 - DNA, 55 bp, Artificial Sequence
  Synthetic polynucleotide
gtaggtcagagggcagaatcggtatgacagagggcagaatcggtatgaagaaggc

SEQ ID NO: 6148 - DNA, 55 bp, Artificial Sequence
  Synthetic polynucleotide
ttgggacaaggtcttcaaccaaagagtacaaggtcttcaaccaaagagtcgggtt

SEQ ID NO: 6149 - DNA, 55 bp, Artificial Sequence
  Synthetic polynucleotide
tacgtgccggaaggcagtatgatacgctgccggaaggcagtatgatacgcacagg

SEQ ID NO: 6150 - DNA, 55 bp, Artificial Sequence
  Synthetic polynucleotide
gccaatgggcaacccatcctggcctgaaatgggcaacccatcctggcctgacccc

SEQ ID NO: 6151 - DNA, 55 bp, Artificial Sequence
  Synthetic polynucleotide
catgaagggattcaaacgagttttttttgaagggattcaaacgagttttttttca

SEQ ID NO: 6152 - DNA, 55 bp, Artificial Sequence
  Synthetic polynucleotide
cctcatccgacctatatgtggagaggcgagaggccggcgagataattcccgtgag

SEQ ID NO: 6153 - DNA, 55 bp, Artificial Sequence
  Synthetic polynucleotide
gtccgtctcataacggacacgttggggcgttggggattcctgcgagccttcgcat

SEQ ID NO: 6154 - DNA, 55 bp, Artificial Sequence
  Synthetic polynucleotide
gagttcgtgtcagttccttatcgggactatcgggaccggtcctctcgtataggtc

SEQ ID NO: 6155 - DNA, 55 bp, Artificial Sequence
  Synthetic polynucleotide
cacccgcatcacccaggcctcggttggcctcggttggttctgctcgagacctttc

SEQ ID NO: 6156 - DNA, 55 bp, Artificial Sequence
  Synthetic polynucleotide
agcccgtaaaacagtcagaaggaagtaagaaggaagtaacgttgacaggcgtcta

SEQ ID NO: 6157 - DNA, 55 bp, Artificial Sequence
  Synthetic polynucleotide
gggactacattatgaataaggcgacttataaggcgacttgcgatcgagacatact

SEQ ID NO: 6158 - DNA, 55 bp, Artificial Sequence
  Synthetic polynucleotide
tgatctcttaggaagtgtgggctcaaagtgtgggctcaaagttccacgtgtaatc

SEQ ID NO: 6159 - DNA, 55 bp, Artificial Sequence
  Synthetic polynucleotide
aggtttggaacacgcgcgggccgtccggcgcgggccgtccgtgtgttccacagct

SEQ ID NO: 6160 - DNA, 55 bp, Artificial Sequence
  Synthetic polynucleotide
cgaacatgacacttgtggcgtagtgatttgtggcgtagtgatactaggttaattg

SEQ ID NO: 6161 - DNA, 55 bp, Artificial Sequence
  Synthetic polynucleotide
cgcacgtacacttgtggagagttaggcttgtggagagttaggctgggtagttctg

SEQ ID NO: 6162 - DNA, 55 bp, Artificial Sequence
  Synthetic polynucleotide
ggtccgcagtttcgggtactatggcggttcgggtactatggcggagacgaagttc

SEQ ID NO: 6163 - DNA, 55 bp, Artificial Sequence
  Synthetic polynucleotide
gggtcggaacccgggggctagggctatcccgggggctagggctattagcgaacct

SEQ ID NO: 6164 - DNA, 55 bp, Artificial Sequence
  Synthetic polynucleotide
cacacatgggtaggatcgtgcacgcgaggtaggatcgtgcacgcgaagttattcc

SEQ ID NO: 6165 - DNA, 55 bp, Artificial Sequence
  Synthetic polynucleotide
gttaactcgtgggtatctttagtacctcgtgggtatctttagtaccttcgcgtat

SEQ ID NO: 6166 - DNA, 55 bp, Artificial Sequence
  Synthetic polynucleotide
gagtcaaacgggccagaaaactccgggaacgggccagaaaactccggggcatggc

SEQ ID NO: 6167 - DNA, 55 bp, Artificial Sequence
  Synthetic polynucleotide
tataccgcgggagtaaatggactcctgcgcgggagtaaatggactcctgtcggtg

SEQ ID NO: 6168 - DNA, 55 bp, Artificial Sequence
  Synthetic polynucleotide
cgaggaagggattcgcacagtggtattgaagggattcgcacagtggtattgctac

SEQ ID NO: 6169 - DNA, 55 bp, Artificial Sequence
  Synthetic polynucleotide
gtctactggtctcggttagtgtaaaactactggtctcggttagtgtaaaactaga

SEQ ID NO: 6170 - DNA, 55 bp, Artificial Sequence
  Synthetic polynucleotide
gcagttggggaaactgaaccagccccgagttggggaaactgaaccagccccgagt

SEQ ID NO: 6171 - DNA, 55 bp, Artificial Sequence
  Synthetic polynucleotide
tattgagtagggaacgtgcctaagggttaagggtaaatatctatacaactgttcc

SEQ ID NO: 6172 - DNA, 55 bp, Artificial Sequence
  Synthetic polynucleotide
tagcaatagtcttagccggtgcgggcctgcgggcccctaatatgggagaacatag

SEQ ID NO: 6173 - DNA, 55 bp, Artificial Sequence
  Synthetic polynucleotide
ggacggtgattaagatgaactaggagaactaggagatccctagggccggtccttg

SEQ ID NO: 6174 - DNA, 55 bp, Artificial Sequence
  Synthetic polynucleotide
agtacggtgacgggcttttgagggcgtttgagggcgttctgtacccgtaatcggt

SEQ ID NO: 6175 - DNA, 55 bp, Artificial Sequence
  Synthetic polynucleotide
ggtctggaaacgctttccatgggacggccatgggacggttgcataccgtcaaact

SEQ ID NO: 6176 - DNA, 55 bp, Artificial Sequence
  Synthetic polynucleotide
cgacattgagccaacctcagggctgacctcagggctgaccgaatgaattatctgt

SEQ ID NO: 6177 - DNA, 55 bp, Artificial Sequence
  Synthetic polynucleotide
tgcataagtttttcttaaggcgtgcctttaaggcgtgcctttgtcggtcctggac

SEQ ID NO: 6178 - DNA, 55 bp, Artificial Sequence
  Synthetic polynucleotide
cgcatgtagtccctcaaggtatcggtatcaaggtatcggtaaattcccagcaaca

SEQ ID NO: 6179 - DNA, 55 bp, Artificial Sequence
  Synthetic polynucleotide
ttgaaggatttagccggggtcctagacgccggggtcctagacgaaagggccacgc

SEQ ID NO: 6180 - DNA, 55 bp, Artificial Sequence
  Synthetic polynucleotide
aactggggcatctctggaacgaagcctctctggaacgaagcctcccatacacggg

SEQ ID NO: 6181 - DNA, 55 bp, Artificial Sequence
  Synthetic polynucleotide
gcaccctgtgtccgggctagcctcagatccgggctagcctcagagacaaagaagg

SEQ ID NO: 6182 - DNA, 55 bp, Artificial Sequence
  Synthetic polynucleotide
tcatgctttctctgggactttattgagctctgggactttattgagcggtcagctc

SEQ ID NO: 6183 - DNA, 55 bp, Artificial Sequence
  Synthetic polynucleotide
gttttgaggtggggagtcgtttagcgcgtggggagtcgtttagcgcatgtcttta

SEQ ID NO: 6184 - DNA, 55 bp, Artificial Sequence
  Synthetic polynucleotide
ttaacttcggaggcgtgccagatagcccggaggcgtgccagatagcccgtaatgg

SEQ ID NO: 6185 - DNA, 55 bp, Artificial Sequence
  Synthetic polynucleotide
tgaccaagatgggcgttctgaaatggaagatgggcgttctgaaatggatatctat

SEQ ID NO: 6186 - DNA, 55 bp, Artificial Sequence
  Synthetic polynucleotide
gtcctgtatggaaatacgggcaagcgcgtatggaaatacgggcaagcgcacctgg

SEQ ID NO: 6187 - DNA, 55 bp, Artificial Sequence
  Synthetic polynucleotide
gtattgttggaggcgttgagtggttgttgttggaggcgttgagtggttgtgacca

SEQ ID NO: 6188 - DNA, 55 bp, Artificial Sequence
  Synthetic polynucleotide
gtagactggttacgtggctgcggaattgactggttacgtggctgcggaattttga

SEQ ID NO: 6189 - DNA, 55 bp, Artificial Sequence
  Synthetic polynucleotide
tgcaacggccgaacttcgcgtcaaaatcaacggccgaacttcgcgtcaaaattat

SEQ ID NO: 6190 - DNA, 55 bp, Artificial Sequence
  Synthetic polynucleotide
agtgcacgagtgacgggataatgtgaaaacaggtaattgataggcttccaactta

SEQ ID NO: 6191 - DNA, 55 bp, Artificial Sequence
  Synthetic polynucleotide
agtgcacgagtgacgggataatgtgcccccaggtaattgataggcttccaactta

SEQ ID NO: 6192 - DNA, 55 bp, Artificial Sequence
  Synthetic polynucleotide
agtgcacgagtgacgggataatgtgggggcaggtaattgataggcttccaactta

SEQ ID NO: 6193 - DNA, 55 bp, Artificial Sequence
  Synthetic polynucleotide
agtgcacgagtgacgggataatgtgttttcaggtaattgataggcttccaactta

SEQ ID NO: 6194 - DNA, 55 bp, Artificial Sequence
  Synthetic polynucleotide
agtgcacgagtgacgggataatgtgacaccaggtaattgataggcttccaactta

SEQ ID NO: 6195 - DNA, 55 bp, Artificial Sequence
  Synthetic polynucleotide
agtgcacgagtgacgggataatgtgagagcaggtaattgataggcttccaactta

SEQ ID NO: 6196 - DNA, 55 bp, Artificial Sequence
  Synthetic polynucleotide
agtgcacgagtgacgggataatgtgatatcaggtaattgataggcttccaactta

SEQ ID NO: 6197 - DNA, 55 bp, Artificial Sequence
  Synthetic polynucleotide
agtgcacgagtgacgggataatgtgcacacaggtaattgataggcttccaactta

SEQ ID NO: 6198 - DNA, 55 bp, Artificial Sequence
  Synthetic polynucleotide
agtgcacgagtgacgggataatgtgcgcgcaggtaattgataggcttccaactta

SEQ ID NO: 6199 - DNA, 55 bp, Artificial Sequence
  Synthetic polynucleotide
agtgcacgagtgacgggataatgtgctctcaggtaattgataggcttccaactta

SEQ ID NO: 6200 - DNA, 55 bp, Artificial Sequence
  Synthetic polynucleotide
agtgcacgagtgacgggataatgtggagacaggtaattgataggcttccaactta

SEQ ID NO: 6201 - DNA, 55 bp, Artificial Sequence
  Synthetic polynucleotide
agtgcacgagtgacgggataatgtggcgccaggtaattgataggcttccaactta

SEQ ID NO: 6202 - DNA, 55 bp, Artificial Sequence
  Synthetic polynucleotide
agtgcacgagtgacgggataatgtggtgtcaggtaattgataggcttccaactta

SEQ ID NO: 6203 - DNA, 55 bp, Artificial Sequence
  Synthetic polynucleotide
agtgcacgagtgacgggataatgtgtatacaggtaattgataggcttccaactta

SEQ ID NO: 6204 - DNA, 55 bp, Artificial Sequence
  Synthetic polynucleotide
agtgcacgagtgacgggataatgtgtctccaggtaattgataggcttccaactta

SEQ ID NO: 6205 - DNA, 55 bp, Artificial Sequence
  Synthetic polynucleotide
agtgcacgagtgacgggataatgtgtgtgcaggtaattgataggcttccaactta

SEQ ID NO: 6206 - DNA, 55 bp, Artificial Sequence
  Synthetic polynucleotide
agtgcacgagtgacgggataatgtgatagcaggtaattgataggcttccaactta

SEQ ID NO: 6207 - DNA, 55 bp, Artificial Sequence
  Synthetic polynucleotide
agtgcacgagtgacgggataatgtgacatcaggtaattgataggcttccaactta

SEQ ID NO: 6208 - DNA, 55 bp, Artificial Sequence
  Synthetic polynucleotide
agtgcacgagtgacgggataatgtgagatcaggtaattgataggcttccaactta

SEQ ID NO: 6209 - DNA, 55 bp, Artificial Sequence
  Synthetic polynucleotide
agtgcacgagtgacgggataatgtgagaccaggtaattgataggcttccaactta

SEQ ID NO: 6210 - DNA, 55 bp, Artificial Sequence
  Synthetic polynucleotide
agtgcacgagtgacgggataatgtgataccaggtaattgataggcttccaactta

SEQ ID NO: 6211 - DNA, 55 bp, Artificial Sequence
  Synthetic polynucleotide
agtgcacgagtgacgggataatgtgcgctcaggtaattgataggcttccaactta

SEQ ID NO: 6212 - DNA, 55 bp, Artificial Sequence
  Synthetic polynucleotide
agtgcacgagtgacgggataatgtgcacgcaggtaattgataggcttccaactta

SEQ ID NO: 6213 - DNA, 55 bp, Artificial Sequence
  Synthetic polynucleotide
agtgcacgagtgacgggataatgtgctcgcaggtaattgataggcttccaactta

SEQ ID NO: 6214 - DNA, 55 bp, Artificial Sequence
  Synthetic polynucleotide
agtgcacgagtgacgggataatgtgctcacaggtaattgataggcttccaactta

SEQ ID NO: 6215 - DNA, 55 bp, Artificial Sequence
  Synthetic polynucleotide
agtgcacgagtgacgggataatgtgcactcaggtaattgataggcttccaactta

SEQ ID NO: 6216 - DNA, 55 bp, Artificial Sequence
  Synthetic polynucleotide
agtgcacgagtgacgggataatgtggcgtcaggtaattgataggcttccaactta

SEQ ID NO: 6217 - DNA, 55 bp, Artificial Sequence
  Synthetic polynucleotide
agtgcacgagtgacgggataatgtggagccaggtaattgataggcttccaactta

SEQ ID NO: 6218 - DNA, 55 bp, Artificial Sequence
  Synthetic polynucleotide
agtgcacgagtgacgggataatgtggtgccaggtaattgataggcttccaactta

SEQ ID NO: 6219 - DNA, 55 bp, Artificial Sequence
  Synthetic polynucleotide
agtgcacgagtgacgggataatgtggagtcaggtaattgataggcttccaactta

SEQ ID NO: 6220 - DNA, 55 bp, Artificial Sequence
  Synthetic polynucleotide
agtgcacgagtgacgggataatgtggtgacaggtaattgataggcttccaactta

SEQ ID NO: 6221 - DNA, 55 bp, Artificial Sequence
  Synthetic polynucleotide
agtgcacgagtgacgggataatgtgtatccaggtaattgataggcttccaactta

SEQ ID NO: 6222 - DNA, 55 bp, Artificial Sequence
  Synthetic polynucleotide
agtgcacgagtgacgggataatgtgtctacaggtaattgataggcttccaactta

SEQ ID NO: 6223 - DNA, 55 bp, Artificial Sequence
  Synthetic polynucleotide
agtgcacgagtgacgggataatgtgtgtccaggtaattgataggcttccaactta

SEQ ID NO: 6224 - DNA, 55 bp, Artificial Sequence
  Synthetic polynucleotide
agtgcacgagtgacgggataatgtgtgtacaggtaattgataggcttccaactta

SEQ ID NO: 6225 - DNA, 55 bp, Artificial Sequence
  Synthetic polynucleotide
agtgcacgagtgacgggataatgtgtatgcaggtaattgataggcttccaactta

SEQ ID NO: 6226 - DNA, 55 bp, Artificial Sequence
  Synthetic polynucleotide
agtgcacgagtgacgggataatgtgtagacaggtaattgataggcttccaactta

SEQ ID NO: 6227 - DNA, 55 bp, Artificial Sequence
  Synthetic polynucleotide
agtgcacgagtgacgggataatgtgtacacaggtaattgataggcttccaactta

SEQ ID NO: 6228 - DNA, 55 bp, Artificial Sequence
  Synthetic polynucleotide
agtgcacgagtgacgggataatgtggacacaggtaattgataggcttccaactta

SEQ ID NO: 6229 - DNA, 55 bp, Artificial Sequence
  Synthetic polynucleotide
agtgcacgagtgacgggataatgtgcagacaggtaattgataggcttccaactta

SEQ ID NO: 6230 - DNA, 55 bp, Artificial Sequence
  Synthetic polynucleotide
agtgcacgagtgacgggataatgtggatacaggtaattgataggcttccaactta

SEQ ID NO: 6231 - DNA, 55 bp, Artificial Sequence
  Synthetic polynucleotide
agtgcacgagtgacgggataatgtgacgccaggtaattgataggcttccaactta

SEQ ID NO: 6232 - DNA, 55 bp, Artificial Sequence
  Synthetic polynucleotide
agtgcacgagtgacgggataatgtgtcaccaggtaattgataggcttccaactta

SEQ ID NO: 6233 - DNA, 55 bp, Artificial Sequence
  Synthetic polynucleotide
agtgcacgagtgacgggataatgtggcaccaggtaattgataggcttccaactta

SEQ ID NO: 6234 - DNA, 55 bp, Artificial Sequence
  Synthetic polynucleotide
agtgcacgagtgacgggataatgtggctccaggtaattgataggcttccaactta

SEQ ID NO: 6235 - DNA, 55 bp, Artificial Sequence
  Synthetic polynucleotide
agtgcacgagtgacgggataatgtgtcgccaggtaattgataggcttccaactta

SEQ ID NO: 6236 - DNA, 55 bp, Artificial Sequence
  Synthetic polynucleotide
agtgcacgagtgacgggataatgtgcgagcaggtaattgataggcttccaactta

SEQ ID NO: 6237 - DNA, 55 bp, Artificial Sequence
  Synthetic polynucleotide
agtgcacgagtgacgggataatgtgagcgcaggtaattgataggcttccaactta

SEQ ID NO: 6238 - DNA, 55 bp, Artificial Sequence
  Synthetic polynucleotide
agtgcacgagtgacgggataatgtgagtgcaggtaattgataggcttccaactta

SEQ ID NO: 6239 - DNA, 55 bp, Artificial Sequence
  Synthetic polynucleotide
agtgcacgagtgacgggataatgtgtgagcaggtaattgataggcttccaactta

SEQ ID NO: 6240 - DNA, 55 bp, Artificial Sequence
  Synthetic polynucleotide
agtgcacgagtgacgggataatgtgtgcgcaggtaattgataggcttccaactta

SEQ ID NO: 6241 - DNA, 55 bp, Artificial Sequence
  Synthetic polynucleotide
agtgcacgagtgacgggataatgtggtctcaggtaattgataggcttccaactta

SEQ ID NO: 6242 - DNA, 55 bp, Artificial Sequence
  Synthetic polynucleotide
agtgcacgagtgacgggataatgtgctatcaggtaattgataggcttccaactta

SEQ ID NO: 6243 - DNA, 55 bp, Artificial Sequence
  Synthetic polynucleotide
agtgcacgagtgacgggataatgtgatgtcaggtaattgataggcttccaactta

SEQ ID NO: 6244 - DNA, 55 bp, Artificial Sequence
  Synthetic polynucleotide
agtgcacgagtgacgggataatgtgctgtcaggtaattgataggcttccaactta

SEQ ID NO: 6245 - DNA, 55 bp, Artificial Sequence
  Synthetic polynucleotide
agtgcacgagtgacgggataatgtgatctcaggtaattgataggcttccaactta

SEQ ID NO: 6246 - DNA, 55 bp, Artificial Sequence
  Synthetic polynucleotide
agtgcacgagtgacgggataatgtgacgtcaggtaattgataggcttccaactta

SEQ ID NO: 6247 - DNA, 55 bp, Artificial Sequence
  Synthetic polynucleotide
agtgcacgagtgacgggataatgtgactacaggtaattgataggcttccaactta

SEQ ID NO: 6248 - DNA, 55 bp, Artificial Sequence
  Synthetic polynucleotide
agtgcacgagtgacgggataatgtgagtacaggtaattgataggcttccaactta

SEQ ID NO: 6249 - DNA, 55 bp, Artificial Sequence
  Synthetic polynucleotide
agtgcacgagtgacgggataatgtgactgcaggtaattgataggcttccaactta

SEQ ID NO: 6250 - DNA, 55 bp, Artificial Sequence
  Synthetic polynucleotide
agtgcacgagtgacgggataatgtgatcgcaggtaattgataggcttccaactta

SEQ ID NO: 6251 - DNA, 55 bp, Artificial Sequence
  Synthetic polynucleotide
agtgcacgagtgacgggataatgtgctgacaggtaattgataggcttccaactta

SEQ ID NO: 6252 - DNA, 55 bp, Artificial Sequence
  Synthetic polynucleotide
agtgcacgagtgacgggataatgtgcgtacaggtaattgataggcttccaactta

SEQ ID NO: 6253 - DNA, 55 bp, Artificial Sequence
  Synthetic polynucleotide
agtgcacgagtgacgggataatgtgcatgcaggtaattgataggcttccaactta

SEQ ID NO: 6254 - DNA, 55 bp, Artificial Sequence
  Synthetic polynucleotide
agtgcacgagtgacgggataatgtgctaccaggtaattgataggcttccaactta

SEQ ID NO: 6255 - DNA, 55 bp, Artificial Sequence
  Synthetic polynucleotide
agtgcacgagtgacgggataatgtgcgaccaggtaattgataggcttccaactta

SEQ ID NO: 6256 - DNA, 55 bp, Artificial Sequence
  Synthetic polynucleotide
agtgcacgagtgacgggataatgtggtaccaggtaattgataggcttccaactta

SEQ ID NO: 6257 - DNA, 55 bp, Artificial Sequence
  Synthetic polynucleotide
agtgcacgagtgacgggataatgtggatgcaggtaattgataggcttccaactta

SEQ ID NO: 6258 - DNA, 55 bp, Artificial Sequence
  Synthetic polynucleotide
agtgcacgagtgacgggataatgtggactcaggtaattgataggcttccaactta

SEQ ID NO: 6259 - DNA, 55 bp, Artificial Sequence
  Synthetic polynucleotide
agtgcacgagtgacgggataatgtggctacaggtaattgataggcttccaactta

SEQ ID NO: 6260 - DNA, 55 bp, Artificial Sequence
  Synthetic polynucleotide
agtgcacgagtgacgggataatgtggtcgcaggtaattgataggcttccaactta

SEQ ID NO: 6261 - DNA, 55 bp, Artificial Sequence
  Synthetic polynucleotide
agtgcacgagtgacgggataatgtgtagccaggtaattgataggcttccaactta

SEQ ID NO: 6262 - DNA, 55 bp, Artificial Sequence
  Synthetic polynucleotide
agtgcacgagtgacgggataatgtgtgaccaggtaattgataggcttccaactta

SEQ ID NO: 6263 - DNA, 55 bp, Artificial Sequence
  Synthetic polynucleotide
agtgcacgagtgacgggataatgtgtgcacaggtaattgataggcttccaactta

SEQ ID NO: 6264 - DNA, 55 bp, Artificial Sequence
  Synthetic polynucleotide
agtgcacgagtgacgggataatgtgtcgtcaggtaattgataggcttccaactta

SEQ ID NO: 6265 - DNA, 55 bp, Artificial Sequence
  Synthetic polynucleotide
agtgcacgagtgacgggataatgtgtcgacaggtaattgataggcttccaactta

SEQ ID NO: 6266 - DNA, 55 bp, Artificial Sequence
  Synthetic polynucleotide
ccgagacctacgcgaaccgaaatcgaaaaccggtgcgcaagcagggctggcgtcc

SEQ ID NO: 6267 - DNA, 55 bp, Artificial Sequence
  Synthetic polynucleotide
ccgagacctacgcgaaccgaaatcgccccccggtgcgcaagcagggctggcgtcc

SEQ ID NO: 6268 - DNA, 55 bp, Artificial Sequence
  Synthetic polynucleotide
ccgagacctacgcgaaccgaaatcgggggccggtgcgcaagcagggctggcgtcc

SEQ ID NO: 6269 - DNA, 55 bp, Artificial Sequence
  Synthetic polynucleotide
ccgagacctacgcgaaccgaaatcgttttccggtgcgcaagcagggctggcgtcc

SEQ ID NO: 6270 - DNA, 55 bp, Artificial Sequence
  Synthetic polynucleotide
ccgagacctacgcgaaccgaaatcgacacccggtgcgcaagcagggctggcgtcc

SEQ ID NO: 6271 - DNA, 55 bp, Artificial Sequence
  Synthetic polynucleotide
ccgagacctacgcgaaccgaaatcgagagccggtgcgcaagcagggctggcgtcc

SEQ ID NO: 6272 - DNA, 55 bp, Artificial Sequence
  Synthetic polynucleotide
ccgagacctacgcgaaccgaaatcgatatccggtgcgcaagcagggctggcgtcc

SEQ ID NO: 6273 - DNA, 55 bp, Artificial Sequence
  Synthetic polynucleotide
ccgagacctacgcgaaccgaaatcgcacaccggtgcgcaagcagggctggcgtcc

SEQ ID NO: 6274 - DNA, 55 bp, Artificial Sequence
  Synthetic polynucleotide
ccgagacctacgcgaaccgaaatcgcgcgccggtgcgcaagcagggctggcgtcc

SEQ ID NO: 6275 - DNA, 55 bp, Artificial Sequence
  Synthetic polynucleotide
ccgagacctacgcgaaccgaaatcgctctccggtgcgcaagcagggctggcgtcc

SEQ ID NO: 6276 - DNA, 55 bp, Artificial Sequence
  Synthetic polynucleotide
ccgagacctacgcgaaccgaaatcggagaccggtgcgcaagcagggctggcgtcc

SEQ ID NO: 6277 - DNA, 55 bp, Artificial Sequence
  Synthetic polynucleotide
ccgagacctacgcgaaccgaaatcggcgcccggtgcgcaagcagggctggcgtcc

SEQ ID NO: 6278 - DNA, 55 bp, Artificial Sequence
  Synthetic polynucleotide
ccgagacctacgcgaaccgaaatcggtgtccggtgcgcaagcagggctggcgtcc

SEQ ID NO: 6279 - DNA, 55 bp, Artificial Sequence
  Synthetic polynucleotide
ccgagacctacgcgaaccgaaatcgtataccggtgcgcaagcagggctggcgtcc

SEQ ID NO: 6280 - DNA, 55 bp, Artificial Sequence
  Synthetic polynucleotide
ccgagacctacgcgaaccgaaatcgtctcccggtgcgcaagcagggctggcgtcc

SEQ ID NO: 6281 - DNA, 55 bp, Artificial Sequence
  Synthetic polynucleotide
ccgagacctacgcgaaccgaaatcgtgtgccggtgcgcaagcagggctggcgtcc

SEQ ID NO: 6282 - DNA, 55 bp, Artificial Sequence
  Synthetic polynucleotide
ccgagacctacgcgaaccgaaatcgacatccggtgcgcaagcagggctggcgtcc

SEQ ID NO: 6283 - DNA, 55 bp, Artificial Sequence
  Synthetic polynucleotide
ccgagacctacgcgaaccgaaatcgatagccggtgcgcaagcagggctggcgtcc

SEQ ID NO: 6284 - DNA, 55 bp, Artificial Sequence
  Synthetic polynucleotide
ccgagacctacgcgaaccgaaatcgacagccggtgcgcaagcagggctggcgtcc

SEQ ID NO: 6285 - DNA, 55 bp, Artificial Sequence
  Synthetic polynucleotide
ccgagacctacgcgaaccgaaatcgatacccggtgcgcaagcagggctggcgtcc

SEQ ID NO: 6286 - DNA, 55 bp, Artificial Sequence
  Synthetic polynucleotide
ccgagacctacgcgaaccgaaatcgagatccggtgcgcaagcagggctggcgtcc

SEQ ID NO: 6287 - DNA, 55 bp, Artificial Sequence
  Synthetic polynucleotide
ccgagacctacgcgaaccgaaatcgcgctccggtgcgcaagcagggctggcgtcc

SEQ ID NO: 6288 - DNA, 55 bp, Artificial Sequence
  Synthetic polynucleotide
ccgagacctacgcgaaccgaaatcgcacgccggtgcgcaagcagggctggcgtcc

SEQ ID NO: 6289 - DNA, 55 bp, Artificial Sequence
  Synthetic polynucleotide
ccgagacctacgcgaaccgaaatcgctcaccggtgcgcaagcagggctggcgtcc

SEQ ID NO: 6290 - DNA, 55 bp, Artificial Sequence
  Synthetic polynucleotide
ccgagacctacgcgaaccgaaatcgcactccggtgcgcaagcagggctggcgtcc

SEQ ID NO: 6291 - DNA, 55 bp, Artificial Sequence
  Synthetic polynucleotide
ccgagacctacgcgaaccgaaatcgcgcaccggtgcgcaagcagggctggcgtcc

SEQ ID NO: 6292 - DNA, 55 bp, Artificial Sequence
  Synthetic polynucleotide
ccgagacctacgcgaaccgaaatcggtgcccggtgcgcaagcagggctggcgtcc

SEQ ID NO: 6293 - DNA, 55 bp, Artificial Sequence
  Synthetic polynucleotide
ccgagacctacgcgaaccgaaatcggtgaccggtgcgcaagcagggctggcgtcc

SEQ ID NO: 6294 - DNA, 55 bp, Artificial Sequence
  Synthetic polynucleotide
ccgagacctacgcgaaccgaaatcggcgaccggtgcgcaagcagggctggcgtcc

SEQ ID NO: 6295 - DNA, 55 bp, Artificial Sequence
  Synthetic polynucleotide
ccgagacctacgcgaaccgaaatcggcgtccggtgcgcaagcagggctggcgtcc

SEQ ID NO: 6296 - DNA, 55 bp, Artificial Sequence
  Synthetic polynucleotide
ccgagacctacgcgaaccgaaatcggagcccggtgcgcaagcagggctggcgtcc

SEQ ID NO: 6297 - DNA, 55 bp, Artificial Sequence
  Synthetic polynucleotide
ccgagacctacgcgaaccgaaatcgtgtaccggtgcgcaagcagggctggcgtcc

SEQ ID NO: 6298 - DNA, 55 bp, Artificial Sequence
  Synthetic polynucleotide
ccgagacctacgcgaaccgaaatcgtatgccggtgcgcaagcagggctggcgtcc

SEQ ID NO: 6299 - DNA, 55 bp, Artificial Sequence
  Synthetic polynucleotide
ccgagacctacgcgaaccgaaatcgtatcccggtgcgcaagcagggctggcgtcc

SEQ ID NO: 6300 - DNA, 55 bp, Artificial Sequence
  Synthetic polynucleotide
ccgagacctacgcgaaccgaaatcgtctaccggtgcgcaagcagggctggcgtcc

SEQ ID NO: 6301 - DNA, 55 bp, Artificial Sequence
  Synthetic polynucleotide
ccgagacctacgcgaaccgaaatcgtgtcccggtgcgcaagcagggctggcgtcc

SEQ ID NO: 6302 - DNA, 55 bp, Artificial Sequence
  Synthetic polynucleotide
ccgagacctacgcgaaccgaaatcgtagaccggtgcgcaagcagggctggcgtcc

SEQ ID NO: 6303 - DNA, 55 bp, Artificial Sequence
  Synthetic polynucleotide
ccgagacctacgcgaaccgaaatcggataccggtgcgcaagcagggctggcgtcc

SEQ ID NO: 6304 - DNA, 55 bp, Artificial Sequence
  Synthetic polynucleotide
ccgagacctacgcgaaccgaaatcgcagaccggtgcgcaagcagggctggcgtcc

SEQ ID NO: 6305 - DNA, 55 bp, Artificial Sequence
  Synthetic polynucleotide
ccgagacctacgcgaaccgaaatcggacaccggtgcgcaagcagggctggcgtcc

SEQ ID NO: 6306 - DNA, 55 bp, Artificial Sequence
  Synthetic polynucleotide
ccgagacctacgcgaaccgaaatcgtacaccggtgcgcaagcagggctggcgtcc

SEQ ID NO: 6307 - DNA, 55 bp, Artificial Sequence
  Synthetic polynucleotide
ccgagacctacgcgaaccgaaatcggcacccggtgcgcaagcagggctggcgtcc

SEQ ID NO: 6308 - DNA, 55 bp, Artificial Sequence
  Synthetic polynucleotide
ccgagacctacgcgaaccgaaatcgtcacccggtgcgcaagcagggctggcgtcc

SEQ ID NO: 6309 - DNA, 55 bp, Artificial Sequence
  Synthetic polynucleotide
ccgagacctacgcgaaccgaaatcgactcccggtgcgcaagcagggctggcgtcc

SEQ ID NO: 6310 - DNA, 55 bp, Artificial Sequence
  Synthetic polynucleotide
ccgagacctacgcgaaccgaaatcggctcccggtgcgcaagcagggctggcgtcc

SEQ ID NO: 6311 - DNA, 55 bp, Artificial Sequence
  Synthetic polynucleotide
ccgagacctacgcgaaccgaaatcgtcgcccggtgcgcaagcagggctggcgtcc

SEQ ID NO: 6312 - DNA, 55 bp, Artificial Sequence
  Synthetic polynucleotide
ccgagacctacgcgaaccgaaatcgtgagccggtgcgcaagcagggctggcgtcc

SEQ ID NO: 6313 - DNA, 55 bp, Artificial Sequence
  Synthetic polynucleotide
ccgagacctacgcgaaccgaaatcgagtgccggtgcgcaagcagggctggcgtcc

SEQ ID NO: 6314 - DNA, 55 bp, Artificial Sequence
  Synthetic polynucleotide
ccgagacctacgcgaaccgaaatcgtgcgccggtgcgcaagcagggctggcgtcc

SEQ ID NO: 6315 - DNA, 55 bp, Artificial Sequence
  Synthetic polynucleotide
ccgagacctacgcgaaccgaaatcgagcgccggtgcgcaagcagggctggcgtcc

SEQ ID NO: 6316 - DNA, 55 bp, Artificial Sequence
  Synthetic polynucleotide
ccgagacctacgcgaaccgaaatcgcgtgccggtgcgcaagcagggctggcgtcc

SEQ ID NO: 6317 - DNA, 55 bp, Artificial Sequence
  Synthetic polynucleotide
ccgagacctacgcgaaccgaaatcgctgtccggtgcgcaagcagggctggcgtcc

SEQ ID NO: 6318 - DNA, 55 bp, Artificial Sequence
  Synthetic polynucleotide
ccgagacctacgcgaaccgaaatcggtatccggtgcgcaagcagggctggcgtcc

SEQ ID NO: 6319 - DNA, 55 bp, Artificial Sequence
  Synthetic polynucleotide
ccgagacctacgcgaaccgaaatcgatctccggtgcgcaagcagggctggcgtcc

SEQ ID NO: 6320 - DNA, 55 bp, Artificial Sequence
  Synthetic polynucleotide
ccgagacctacgcgaaccgaaatcggtctccggtgcgcaagcagggctggcgtcc

SEQ ID NO: 6321 - DNA, 55 bp, Artificial Sequence
  Synthetic polynucleotide
ccgagacctacgcgaaccgaaatcgatgtccggtgcgcaagcagggctggcgtcc

SEQ ID NO: 6322 - DNA, 55 bp, Artificial Sequence
  Synthetic polynucleotide
ccgagacctacgcgaaccgaaatcgagtcccggtgcgcaagcagggctggcgtcc

SEQ ID NO: 6323 - DNA, 55 bp, Artificial Sequence
  Synthetic polynucleotide
ccgagacctacgcgaaccgaaatcgatgcccggtgcgcaagcagggctggcgtcc

SEQ ID NO: 6324 - DNA, 55 bp, Artificial Sequence
  Synthetic polynucleotide
ccgagacctacgcgaaccgaaatcgatcgccggtgcgcaagcagggctggcgtcc

SEQ ID NO: 6325 - DNA, 55 bp, Artificial Sequence
  Synthetic polynucleotide
ccgagacctacgcgaaccgaaatcgagtaccggtgcgcaagcagggctggcgtcc

SEQ ID NO: 6326 - DNA, 55 bp, Artificial Sequence
  Synthetic polynucleotide
ccgagacctacgcgaaccgaaatcgactaccggtgcgcaagcagggctggcgtcc

SEQ ID NO: 6327 - DNA, 55 bp, Artificial Sequence
  Synthetic polynucleotide
ccgagacctacgcgaaccgaaatcgcatcccggtgcgcaagcagggctggcgtcc

SEQ ID NO: 6328 - DNA, 55 bp, Artificial Sequence
  Synthetic polynucleotide
ccgagacctacgcgaaccgaaatcgctagccggtgcgcaagcagggctggcgtcc

SEQ ID NO: 6329 - DNA, 55 bp, Artificial Sequence
  Synthetic polynucleotide
ccgagacctacgcgaaccgaaatcgcgatccggtgcgcaagcagggctggcgtcc

SEQ ID NO: 6330 - DNA, 55 bp, Artificial Sequence
  Synthetic polynucleotide
ccgagacctacgcgaaccgaaatcgcgtcccggtgcgcaagcagggctggcgtcc

SEQ ID NO: 6331 - DNA, 55 bp, Artificial Sequence
  Synthetic polynucleotide
ccgagacctacgcgaaccgaaatcgctacccggtgcgcaagcagggctggcgtcc

SEQ ID NO: 6332 - DNA, 55 bp, Artificial Sequence
  Synthetic polynucleotide
ccgagacctacgcgaaccgaaatcggactccggtgcgcaagcagggctggcgtcc

SEQ ID NO: 6333 - DNA, 55 bp, Artificial Sequence
  Synthetic polynucleotide
ccgagacctacgcgaaccgaaatcggatcccggtgcgcaagcagggctggcgtcc

SEQ ID NO: 6334 - DNA, 55 bp, Artificial Sequence
  Synthetic polynucleotide
ccgagacctacgcgaaccgaaatcggatgccggtgcgcaagcagggctggcgtcc

SEQ ID NO: 6335 - DNA, 55 bp, Artificial Sequence
  Synthetic polynucleotide
ccgagacctacgcgaaccgaaatcggtagccggtgcgcaagcagggctggcgtcc

SEQ ID NO: 6336 - DNA, 55 bp, Artificial Sequence
  Synthetic polynucleotide
ccgagacctacgcgaaccgaaatcggcatccggtgcgcaagcagggctggcgtcc

SEQ ID NO: 6337 - DNA, 55 bp, Artificial Sequence
  Synthetic polynucleotide
ccgagacctacgcgaaccgaaatcgtacgccggtgcgcaagcagggctggcgtcc

SEQ ID NO: 6338 - DNA, 55 bp, Artificial Sequence
  Synthetic polynucleotide
ccgagacctacgcgaaccgaaatcgtgctccggtgcgcaagcagggctggcgtcc

SEQ ID NO: 6339 - DNA, 55 bp, Artificial Sequence
  Synthetic polynucleotide
ccgagacctacgcgaaccgaaatcgtgcaccggtgcgcaagcagggctggcgtcc

SEQ ID NO: 6340 - DNA, 55 bp, Artificial Sequence
  Synthetic polynucleotide
ccgagacctacgcgaaccgaaatcgtcgtccggtgcgcaagcagggctggcgtcc

SEQ ID NO: 6341 - DNA, 55 bp, Artificial Sequence
  Synthetic polynucleotide
ccgagacctacgcgaaccgaaatcgtagcccggtgcgcaagcagggctggcgtcc

SEQ ID NO: 6342 - DNA, 55 bp, Artificial Sequence
  Synthetic polynucleotide
gcccccacaaagcggaccagccagcaaaatagggaataaggccaacttgcacccc

SEQ ID NO: 6343 - DNA, 55 bp, Artificial Sequence
  Synthetic polynucleotide
gcccccacaaagcggaccagccagccccctagggaataaggccaacttgcacccc

SEQ ID NO: 6344 - DNA, 55 bp, Artificial Sequence
  Synthetic polynucleotide
gcccccacaaagcggaccagccagcggggtagggaataaggccaacttgcacccc

SEQ ID NO: 6345 - DNA, 55 bp, Artificial Sequence
  Synthetic polynucleotide
gcccccacaaagcggaccagccagctttttagggaataaggccaacttgcacccc

SEQ ID NO: 6346 - DNA, 55 bp, Artificial Sequence
  Synthetic polynucleotide
gcccccacaaagcggaccagccagcacactagggaataaggccaacttgcacccc

SEQ ID NO: 6347 - DNA, 55 bp, Artificial Sequence
  Synthetic polynucleotide
gcccccacaaagcggaccagccagcagagtagggaataaggccaacttgcacccc

SEQ ID NO: 6348 - DNA, 55 bp, Artificial Sequence
  Synthetic polynucleotide
gcccccacaaagcggaccagccagcatattagggaataaggccaacttgcacccc

SEQ ID NO: 6349 - DNA, 55 bp, Artificial Sequence
  Synthetic polynucleotide
gcccccacaaagcggaccagccagccacatagggaataaggccaacttgcacccc

SEQ ID NO: 6350 - DNA, 55 bp, Artificial Sequence
  Synthetic polynucleotide
gcccccacaaagcggaccagccagccgcgtagggaataaggccaacttgcacccc

SEQ ID NO: 6351 - DNA, 55 bp, Artificial Sequence
  Synthetic polynucleotide
gcccccacaaagcggaccagccagcctcttagggaataaggccaacttgcacccc

SEQ ID NO: 6352 - DNA, 55 bp, Artificial Sequence
  Synthetic polynucleotide
gcccccacaaagcggaccagccagcgagatagggaataaggccaacttgcacccc

SEQ ID NO: 6353 - DNA, 55 bp, Artificial Sequence
  Synthetic polynucleotide
gcccccacaaagcggaccagccagcgcgctagggaataaggccaacttgcacccc

SEQ ID NO: 6354 - DNA, 55 bp, Artificial Sequence
  Synthetic polynucleotide
gcccccacaaagcggaccagccagcgtgttagggaataaggccaacttgcacccc

SEQ ID NO: 6355 - DNA, 55 bp, Artificial Sequence
  Synthetic polynucleotide
gcccccacaaagcggaccagccagctatatagggaataaggccaacttgcacccc

SEQ ID NO: 6356 - DNA, 55 bp, Artificial Sequence
  Synthetic polynucleotide
gcccccacaaagcggaccagccagctctctagggaataaggccaacttgcacccc

SEQ ID NO: 6357 - DNA, 55 bp, Artificial Sequence
  Synthetic polynucleotide
gcccccacaaagcggaccagccagctgtgtagggaataaggccaacttgcacccc

SEQ ID NO: 6358 - DNA, 55 bp, Artificial Sequence
  Synthetic polynucleotide
gcccccacaaagcggaccagccagcagactagggaataaggccaacttgcacccc

SEQ ID NO: 6359 - DNA, 55 bp, Artificial Sequence
  Synthetic polynucleotide
gcccccacaaagcggaccagccagcatagtagggaataaggccaacttgcacccc

SEQ ID NO: 6360 - DNA, 55 bp, Artificial Sequence
  Synthetic polynucleotide
gcccccacaaagcggaccagccagcacagtagggaataaggccaacttgcacccc

SEQ ID NO: 6361 - DNA, 55 bp, Artificial Sequence
  Synthetic polynucleotide
gcccccacaaagcggaccagccagcagattagggaataaggccaacttgcacccc

SEQ ID NO: 6362 - DNA, 55 bp, Artificial Sequence
  Synthetic polynucleotide
gcccccacaaagcggaccagccagcatactagggaataaggccaacttgcacccc

SEQ ID NO: 6363 - DNA, 55 bp, Artificial Sequence
  Synthetic polynucleotide
gcccccacaaagcggaccagccagccgcttagggaataaggccaacttgcacccc

SEQ ID NO: 6364 - DNA, 55 bp, Artificial Sequence
  Synthetic polynucleotide
gcccccacaaagcggaccagccagcctcgtagggaataaggccaacttgcacccc

SEQ ID NO: 6365 - DNA, 55 bp, Artificial Sequence
  Synthetic polynucleotide
gcccccacaaagcggaccagccagccacgtagggaataaggccaacttgcacccc

SEQ ID NO: 6366 - DNA, 55 bp, Artificial Sequence
  Synthetic polynucleotide
gcccccacaaagcggaccagccagccgcatagggaataaggccaacttgcacccc

SEQ ID NO: 6367 - DNA, 55 bp, Artificial Sequence
  Synthetic polynucleotide
gcccccacaaagcggaccagccagcctcatagggaataaggccaacttgcacccc

SEQ ID NO: 6368 - DNA, 55 bp, Artificial Sequence
  Synthetic polynucleotide
gcccccacaaagcggaccagccagcgagttagggaataaggccaacttgcacccc

SEQ ID NO: 6369 - DNA, 55 bp, Artificial Sequence
  Synthetic polynucleotide
gcccccacaaagcggaccagccagcgagctagggaataaggccaacttgcacccc

SEQ ID NO: 6370 - DNA, 55 bp, Artificial Sequence
  Synthetic polynucleotide
gcccccacaaagcggaccagccagcgcgatagggaataaggccaacttgcacccc

SEQ ID NO: 6371 - DNA, 55 bp, Artificial Sequence
  Synthetic polynucleotide
gcccccacaaagcggaccagccagcgtgatagggaataaggccaacttgcacccc

SEQ ID NO: 6372 - DNA, 55 bp, Artificial Sequence
  Synthetic polynucleotide
gcccccacaaagcggaccagccagcgtgctagggaataaggccaacttgcacccc

SEQ ID NO: 6373 - DNA, 55 bp, Artificial Sequence
  Synthetic polynucleotide
gcccccacaaagcggaccagccagctctgtagggaataaggccaacttgcacccc

SEQ ID NO: 6374 - DNA, 55 bp, Artificial Sequence
  Synthetic polynucleotide
gcccccacaaagcggaccagccagctatctagggaataaggccaacttgcacccc

SEQ ID NO: 6375 - DNA, 55 bp, Artificial Sequence
  Synthetic polynucleotide
gcccccacaaagcggaccagccagctctatagggaataaggccaacttgcacccc

SEQ ID NO: 6376 - DNA, 55 bp, Artificial Sequence
  Synthetic polynucleotide
gcccccacaaagcggaccagccagctgtctagggaataaggccaacttgcacccc

SEQ ID NO: 6377 - DNA, 55 bp, Artificial Sequence
  Synthetic polynucleotide
gcccccacaaagcggaccagccagctgtatagggaataaggccaacttgcacccc

SEQ ID NO: 6378 - DNA, 55 bp, Artificial Sequence
  Synthetic polynucleotide
gcccccacaaagcggaccagccagctacatagggaataaggccaacttgcacccc

SEQ ID NO: 6379 - DNA, 55 bp, Artificial Sequence
  Synthetic polynucleotide
gcccccacaaagcggaccagccagcgacatagggaataaggccaacttgcacccc

SEQ ID NO: 6380 - DNA, 55 bp, Artificial Sequence
  Synthetic polynucleotide
gcccccacaaagcggaccagccagctagatagggaataaggccaacttgcacccc

SEQ ID NO: 6381 - DNA, 55 bp, Artificial Sequence
  Synthetic polynucleotide
gcccccacaaagcggaccagccagccatatagggaataaggccaacttgcacccc

SEQ ID NO: 6382 - DNA, 55 bp, Artificial Sequence
  Synthetic polynucleotide
gcccccacaaagcggaccagccagcgatatagggaataaggccaacttgcacccc

SEQ ID NO: 6383 - DNA, 55 bp, Artificial Sequence
  Synthetic polynucleotide
gcccccacaaagcggaccagccagcactctagggaataaggccaacttgcacccc

SEQ ID NO: 6384 - DNA, 55 bp, Artificial Sequence
  Synthetic polynucleotide
gcccccacaaagcggaccagccagcgcactagggaataaggccaacttgcacccc

SEQ ID NO: 6385 - DNA, 55 bp, Artificial Sequence
  Synthetic polynucleotide
gcccccacaaagcggaccagccagctcgctagggaataaggccaacttgcacccc

SEQ ID NO: 6386 - DNA, 55 bp, Artificial Sequence
  Synthetic polynucleotide
gcccccacaaagcggaccagccagcacgctagggaataaggccaacttgcacccc

SEQ ID NO: 6387 - DNA, 55 bp, Artificial Sequence
  Synthetic polynucleotide
gcccccacaaagcggaccagccagcgctctagggaataaggccaacttgcacccc

SEQ ID NO: 6388 - DNA, 55 bp, Artificial Sequence
  Synthetic polynucleotide
gcccccacaaagcggaccagccagcagcgtagggaataaggccaacttgcacccc

SEQ ID NO: 6389 - DNA, 55 bp, Artificial Sequence
  Synthetic polynucleotide
gcccccacaaagcggaccagccagccgagtagggaataaggccaacttgcacccc

SEQ ID NO: 6390 - DNA, 55 bp, Artificial Sequence
  Synthetic polynucleotide
gcccccacaaagcggaccagccagctgcgtagggaataaggccaacttgcacccc

SEQ ID NO: 6391 - DNA, 55 bp, Artificial Sequence
  Synthetic polynucleotide
gcccccacaaagcggaccagccagctgagtagggaataaggccaacttgcacccc

SEQ ID NO: 6392 - DNA, 55 bp, Artificial Sequence
  Synthetic polynucleotide
gcccccacaaagcggaccagccagcagtgtagggaataaggccaacttgcacccc

SEQ ID NO: 6393 - DNA, 55 bp, Artificial Sequence
  Synthetic polynucleotide
gcccccacaaagcggaccagccagcatgttagggaataaggccaacttgcacccc

SEQ ID NO: 6394 - DNA, 55 bp, Artificial Sequence
  Synthetic polynucleotide
gcccccacaaagcggaccagccagcgtattagggaataaggccaacttgcacccc

SEQ ID NO: 6395 - DNA, 55 bp, Artificial Sequence
  Synthetic polynucleotide
gcccccacaaagcggaccagccagcctattagggaataaggccaacttgcacccc

SEQ ID NO: 6396 - DNA, 55 bp, Artificial Sequence
  Synthetic polynucleotide
gcccccacaaagcggaccagccagcctgttagggaataaggccaacttgcacccc

SEQ ID NO: 6397 - DNA, 55 bp, Artificial Sequence
  Synthetic polynucleotide
gcccccacaaagcggaccagccagcgtcttagggaataaggccaacttgcacccc

SEQ ID NO: 6398 - DNA, 55 bp, Artificial Sequence
  Synthetic polynucleotide
gcccccacaaagcggaccagccagcactatagggaataaggccaacttgcacccc

SEQ ID NO: 6399 - DNA, 55 bp, Artificial Sequence
  Synthetic polynucleotide
gcccccacaaagcggaccagccagcactgtagggaataaggccaacttgcacccc

SEQ ID NO: 6400 - DNA, 55 bp, Artificial Sequence
  Synthetic polynucleotide
gcccccacaaagcggaccagccagcatcatagggaataaggccaacttgcacccc

SEQ ID NO: 6401 - DNA, 55 bp, Artificial Sequence
  Synthetic polynucleotide
gcccccacaaagcggaccagccagcagcttagggaataaggccaacttgcacccc

SEQ ID NO: 6402 - DNA, 55 bp, Artificial Sequence
  Synthetic polynucleotide
gcccccacaaagcggaccagccagcagtctagggaataaggccaacttgcacccc

SEQ ID NO: 6403 - DNA, 55 bp, Artificial Sequence
  Synthetic polynucleotide
gcccccacaaagcggaccagccagccatctagggaataaggccaacttgcacccc

SEQ ID NO: 6404 - DNA, 55 bp, Artificial Sequence
  Synthetic polynucleotide
gcccccacaaagcggaccagccagccgactagggaataaggccaacttgcacccc

SEQ ID NO: 6405 - DNA, 55 bp, Artificial Sequence
  Synthetic polynucleotide
gcccccacaaagcggaccagccagcctagtagggaataaggccaacttgcacccc

SEQ ID NO: 6406 - DNA, 55 bp, Artificial Sequence
  Synthetic polynucleotide
gcccccacaaagcggaccagccagcctgatagggaataaggccaacttgcacccc

SEQ ID NO: 6407 - DNA, 55 bp, Artificial Sequence
  Synthetic polynucleotide
gcccccacaaagcggaccagccagccagttagggaataaggccaacttgcacccc

SEQ ID NO: 6408 - DNA, 55 bp, Artificial Sequence
  Synthetic polynucleotide
gcccccacaaagcggaccagccagcgtcgtagggaataaggccaacttgcacccc

SEQ ID NO: 6409 - DNA, 55 bp, Artificial Sequence
  Synthetic polynucleotide
gcccccacaaagcggaccagccagcgctgtagggaataaggccaacttgcacccc

SEQ ID NO: 6410 - DNA, 55 bp, Artificial Sequence
  Synthetic polynucleotide
gcccccacaaagcggaccagccagcgcattagggaataaggccaacttgcacccc

SEQ ID NO: 6411 - DNA, 55 bp, Artificial Sequence
  Synthetic polynucleotide
gcccccacaaagcggaccagccagcgctatagggaataaggccaacttgcacccc

SEQ ID NO: 6412 - DNA, 55 bp, Artificial Sequence
  Synthetic polynucleotide
gcccccacaaagcggaccagccagcgacttagggaataaggccaacttgcacccc

SEQ ID NO: 6413 - DNA, 55 bp, Artificial Sequence
  Synthetic polynucleotide
gcccccacaaagcggaccagccagctacgtagggaataaggccaacttgcacccc

SEQ ID NO: 6414 - DNA, 55 bp, Artificial Sequence
  Synthetic polynucleotide
gcccccacaaagcggaccagccagctagttagggaataaggccaacttgcacccc

SEQ ID NO: 6415 - DNA, 55 bp, Artificial Sequence
  Synthetic polynucleotide
gcccccacaaagcggaccagccagctcagtagggaataaggccaacttgcacccc

SEQ ID NO: 6416 - DNA, 55 bp, Artificial Sequence
  Synthetic polynucleotide
gcccccacaaagcggaccagccagctgactagggaataaggccaacttgcacccc

SEQ ID NO: 6417 - DNA, 55 bp, Artificial Sequence
  Synthetic polynucleotide
gcccccacaaagcggaccagccagctagctagggaataaggccaacttgcacccc

SEQ ID NO: 6418 - DNA, 55 bp, Artificial Sequence; identical to SEQ ID NO: 3989
  Synthetic polynucleotide

SEQ ID NO: 6419 - DNA, 55 bp, Artificial Sequence; identical to SEQ ID NO: 3990
  Synthetic polynucleotide

SEQ ID NO: 6420 - DNA, 55 bp, Artificial Sequence; identical to SEQ ID NO: 3991
  Synthetic polynucleotide

SEQ ID NO: 6421 - DNA, 55 bp, Artificial Sequence; identical to SEQ ID NO: 3992
  Synthetic polynucleotide

SEQ ID NO: 6422 - DNA, 55 bp, Artificial Sequence; identical to SEQ ID NO: 3993
  Synthetic polynucleotide

SEQ ID NO: 6423 - DNA, 55 bp, Artificial Sequence; identical to SEQ ID NO: 3994
  Synthetic polynucleotide

SEQ ID NO: 6424 - DNA, 55 bp, Artificial Sequence; identical to SEQ ID NO: 3995
  Synthetic polynucleotide

SEQ ID NO: 6425 - DNA, 55 bp, Artificial Sequence; identical to SEQ ID NO: 3996
  Synthetic polynucleotide

SEQ ID NO: 6426 - DNA, 55 bp, Artificial Sequence; identical to SEQ ID NO: 3997
  Synthetic polynucleotide

SEQ ID NO: 6427 - DNA, 55 bp, Artificial Sequence; identical to SEQ ID NO: 3998
  Synthetic polynucleotide

SEQ ID NO: 6428 - DNA, 55 bp, Artificial Sequence; identical to SEQ ID NO: 3999
  Synthetic polynucleotide

SEQ ID NO: 6429 - DNA, 55 bp, Artificial Sequence; identical to SEQ ID NO: 4000
  Synthetic polynucleotide

SEQ ID NO: 6430 - DNA, 55 bp, Artificial Sequence; identical to SEQ ID NO: 4001
  Synthetic polynucleotide

SEQ ID NO: 6431 - DNA, 55 bp, Artificial Sequence; identical to SEQ ID NO: 4002
  Synthetic polynucleotide

SEQ ID NO: 6432 - DNA, 55 bp, Artificial Sequence; identical to SEQ ID NO: 4003
  Synthetic polynucleotide

SEQ ID NO: 6433 - DNA, 55 bp, Artificial Sequence; identical to SEQ ID NO: 4004
  Synthetic polynucleotide

SEQ ID NO: 6434 - DNA, 55 bp, Artificial Sequence; identical to SEQ ID NO: 4005
  Synthetic polynucleotide

SEQ ID NO: 6435 - DNA, 55 bp, Artificial Sequence; identical to SEQ ID NO: 4006
  Synthetic polynucleotide

SEQ ID NO: 6436 - DNA, 55 bp, Artificial Sequence; identical to SEQ ID NO: 4007
  Synthetic polynucleotide

SEQ ID NO: 6437 - DNA, 55 bp, Artificial Sequence; identical to SEQ ID NO: 4008
  Synthetic polynucleotide

SEQ ID NO: 6438 - DNA, 55 bp, Artificial Sequence; identical to SEQ ID NO: 4009
  Synthetic polynucleotide

SEQ ID NO: 6439 - DNA, 55 bp, Artificial Sequence; identical to SEQ ID NO: 4010
  Synthetic polynucleotide

SEQ ID NO: 6440 - DNA, 55 bp, Artificial Sequence; identical to SEQ ID NO: 4011
  Synthetic polynucleotide

SEQ ID NO: 6441 - DNA, 55 bp, Artificial Sequence; identical to SEQ ID NO: 4012
  Synthetic polynucleotide

SEQ ID NO: 6442 - DNA, 55 bp, Artificial Sequence; identical to SEQ ID NO: 4013
  Synthetic polynucleotide

SEQ ID NO: 6443 - DNA, 55 bp, Artificial Sequence; identical to SEQ ID NO: 4014
  Synthetic polynucleotide

SEQ ID NO: 6444 - DNA, 55 bp, Artificial Sequence; identical to SEQ ID NO: 4015
  Synthetic polynucleotide

SEQ ID NO: 6445 - DNA, 55 bp, Artificial Sequence; identical to SEQ ID NO: 4016
  Synthetic polynucleotide

SEQ ID NO: 6446 - DNA, 55 bp, Artificial Sequence; identical to SEQ ID NO: 4017
  Synthetic polynucleotide

SEQ ID NO: 6447 - DNA, 55 bp, Artificial Sequence; identical to SEQ ID NO: 4018
  Synthetic polynucleotide

SEQ ID NO: 6448 - DNA, 55 bp, Artificial Sequence; identical to SEQ ID NO: 4019
  Synthetic polynucleotide

SEQ ID NO: 6449 - DNA, 55 bp, Artificial Sequence; identical to SEQ ID NO: 4020
  Synthetic polynucleotide

SEQ ID NO: 6450 - DNA, 55 bp, Artificial Sequence; identical to SEQ ID NO: 4021
  Synthetic polynucleotide

SEQ ID NO: 6451 - DNA, 55 bp, Artificial Sequence; identical to SEQ ID NO: 4022
  Synthetic polynucleotide

SEQ ID NO: 6452 - DNA, 55 bp, Artificial Sequence; identical to SEQ ID NO: 4023
  Synthetic polynucleotide

SEQ ID NO: 6453 - DNA, 55 bp, Artificial Sequence; identical to SEQ ID NO: 4024
  Synthetic polynucleotide

SEQ ID NO: 6454 - DNA, 55 bp, Artificial Sequence; identical to SEQ ID NO: 4025
  Synthetic polynucleotide

SEQ ID NO: 6455 - DNA, 55 bp, Artificial Sequence; identical to SEQ ID NO: 4026
  Synthetic polynucleotide

SEQ ID NO: 6456 - DNA, 55 bp, Artificial Sequence; identical to SEQ ID NO: 4027
  Synthetic polynucleotide

SEQ ID NO: 6457 - DNA, 55 bp, Artificial Sequence; identical to SEQ ID NO: 4028
  Synthetic polynucleotide

SEQ ID NO: 6458 - DNA, 55 bp, Artificial Sequence; identical to SEQ ID NO: 4029
  Synthetic polynucleotide

SEQ ID NO: 6459 - DNA, 55 bp, Artificial Sequence; identical to SEQ ID NO: 4030
  Synthetic polynucleotide

SEQ ID NO: 6460 - DNA, 55 bp, Artificial Sequence; identical to SEQ ID NO: 4031
  Synthetic polynucleotide

SEQ ID NO: 6461 - DNA, 55 bp, Artificial Sequence; identical to SEQ ID NO: 4032
  Synthetic polynucleotide

SEQ ID NO: 6462 - DNA, 55 bp, Artificial Sequence; identical to SEQ ID NO: 4033
  Synthetic polynucleotide

SEQ ID NO: 6463 - DNA, 55 bp, Artificial Sequence; identical to SEQ ID NO: 4034
  Synthetic polynucleotide

SEQ ID NO: 6464 - DNA, 55 bp, Artificial Sequence; identical to SEQ ID NO: 4035
  Synthetic polynucleotide

SEQ ID NO: 6465 - DNA, 55 bp, Artificial Sequence; identical to SEQ ID NO: 4036
  Synthetic polynucleotide

SEQ ID NO: 6466 - DNA, 55 bp, Artificial Sequence; identical to SEQ ID NO: 4037
  Synthetic polynucleotide

SEQ ID NO: 6467 - DNA, 55 bp, Artificial Sequence; identical to SEQ ID NO: 4038
  Synthetic polynucleotide

SEQ ID NO: 6468 - DNA, 55 bp, Artificial Sequence; identical to SEQ ID NO: 4039
  Synthetic polynucleotide

SEQ ID NO: 6469 - DNA, 55 bp, Artificial Sequence; identical to SEQ ID NO: 4040
  Synthetic polynucleotide

SEQ ID NO: 6470 - DNA, 55 bp, Artificial Sequence; identical to SEQ ID NO: 4041
  Synthetic polynucleotide

SEQ ID NO: 6471 - DNA, 55 bp, Artificial Sequence; identical to SEQ ID NO: 4042
  Synthetic polynucleotide

SEQ ID NO: 6472 - DNA, 55 bp, Artificial Sequence; identical to SEQ ID NO: 4043
  Synthetic polynucleotide

SEQ ID NO: 6473 - DNA, 55 bp, Artificial Sequence; identical to SEQ ID NO: 4044
  Synthetic polynucleotide

SEQ ID NO: 6474 - DNA, 55 bp, Artificial Sequence; identical to SEQ ID NO: 4045
  Synthetic polynucleotide

SEQ ID NO: 6475 - DNA, 55 bp, Artificial Sequence; identical to SEQ ID NO: 4046
  Synthetic polynucleotide

SEQ ID NO: 6476 - DNA, 55 bp, Artificial Sequence; identical to SEQ ID NO: 4047
  Synthetic polynucleotide

SEQ ID NO: 6477 - DNA, 55 bp, Artificial Sequence; identical to SEQ ID NO: 4048
  Synthetic polynucleotide

SEQ ID NO: 6478 - DNA, 55 bp, Artificial Sequence; identical to SEQ ID NO: 4049
  Synthetic polynucleotide

SEQ ID NO: 6479 - DNA, 55 bp, Artificial Sequence; identical to SEQ ID NO: 4050
  Synthetic polynucleotide

SEQ ID NO: 6480 - DNA, 55 bp, Artificial Sequence; identical to SEQ ID NO: 4051
  Synthetic polynucleotide

SEQ ID NO: 6481 - DNA, 55 bp, Artificial Sequence; identical to SEQ ID NO: 4052
  Synthetic polynucleotide

SEQ ID NO: 6482 - DNA, 55 bp, Artificial Sequence; identical to SEQ ID NO: 4053
  Synthetic polynucleotide

SEQ ID NO: 6483 - DNA, 55 bp, Artificial Sequence; identical to SEQ ID NO: 4054
  Synthetic polynucleotide

SEQ ID NO: 6484 - DNA, 55 bp, Artificial Sequence; identical to SEQ ID NO: 4055
  Synthetic polynucleotide

SEQ ID NO: 6485 - DNA, 55 bp, Artificial Sequence; identical to SEQ ID NO: 4056
  Synthetic polynucleotide

SEQ ID NO: 6486 - DNA, 55 bp, Artificial Sequence; identical to SEQ ID NO: 4057
  Synthetic polynucleotide

SEQ ID NO: 6487 - DNA, 55 bp, Artificial Sequence; identical to SEQ ID NO: 4058
  Synthetic polynucleotide

SEQ ID NO: 6488 - DNA, 55 bp, Artificial Sequence; identical to SEQ ID NO: 4059
  Synthetic polynucleotide

SEQ ID NO: 6489 - DNA, 55 bp, Artificial Sequence; identical to SEQ ID NO: 4060
  Synthetic polynucleotide

SEQ ID NO: 6490 - DNA, 55 bp, Artificial Sequence; identical to SEQ ID NO: 4061
  Synthetic polynucleotide

SEQ ID NO: 6491 - DNA, 55 bp, Artificial Sequence; identical to SEQ ID NO: 4062
  Synthetic polynucleotide

SEQ ID NO: 6492 - DNA, 55 bp, Artificial Sequence; identical to SEQ ID NO: 4063
  Synthetic polynucleotide

SEQ ID NO: 6493 - DNA, 55 bp, Artificial Sequence; identical to SEQ ID NO: 4064
  Synthetic polynucleotide

SEQ ID NO: 6494 - DNA, 55 bp, Artificial Sequence; identical to SEQ ID NO: 4065
  Synthetic polynucleotide

SEQ ID NO: 6495 - DNA, 55 bp, Artificial Sequence; identical to SEQ ID NO: 4066
  Synthetic polynucleotide

SEQ ID NO: 6496 - DNA, 55 bp, Artificial Sequence; identical to SEQ ID NO: 4067
  Synthetic polynucleotide

SEQ ID NO: 6497 - DNA, 55 bp, Artificial Sequence; identical to SEQ ID NO: 4068
  Synthetic polynucleotide

SEQ ID NO: 6498 - DNA, 55 bp, Artificial Sequence; identical to SEQ ID NO: 4069
  Synthetic polynucleotide

SEQ ID NO: 6499 - DNA, 55 bp, Artificial Sequence; identical to SEQ ID NO: 4070
  Synthetic polynucleotide

SEQ ID NO: 6500 - DNA, 55 bp, Artificial Sequence; identical to SEQ ID NO: 4071
  Synthetic polynucleotide

SEQ ID NO: 6501 - DNA, 55 bp, Artificial Sequence; identical to SEQ ID NO: 4072
  Synthetic polynucleotide

SEQ ID NO: 6502 - DNA, 55 bp, Artificial Sequence; identical to SEQ ID NO: 4073
  Synthetic polynucleotide

SEQ ID NO: 6503 - DNA, 55 bp, Artificial Sequence; identical to SEQ ID NO: 4074
  Synthetic polynucleotide

SEQ ID NO: 6504 - DNA, 55 bp, Artificial Sequence; identical to SEQ ID NO: 4075
  Synthetic polynucleotide

SEQ ID NO: 6505 - DNA, 55 bp, Artificial Sequence; identical to SEQ ID NO: 4076
  Synthetic polynucleotide

SEQ ID NO: 6506 - DNA, 55 bp, Artificial Sequence; identical to SEQ ID NO: 4077
  Synthetic polynucleotide

SEQ ID NO: 6507 - DNA, 55 bp, Artificial Sequence; identical to SEQ ID NO: 4078
  Synthetic polynucleotide

SEQ ID NO: 6508 - DNA, 55 bp, Artificial Sequence
  Synthetic polynucleotide
tccctcaagtccttccagcagcagcagcagcagcagcagcagcagcagcagcagc

SEQ ID NO: 6509 - DNA, 55 bp, Artificial Sequence
  Synthetic polynucleotide
gagtccctcaagtccttccagcagcagcagcagcagcagcagcagcagcagcagc

SEQ ID NO: 6510 - DNA, 55 bp, Artificial Sequence
  Synthetic polynucleotide
ttcgagtccctcaagtccttccagcagcagcagcagcagcagcagcagcagcagc

SEQ ID NO: 6511 - DNA, 55 bp, Artificial Sequence
  Synthetic polynucleotide
gccttcgagtccctcaagtccttccagcagcagcagcagcagcagcagcagcagc

SEQ ID NO: 6512 - DNA, 55 bp, Artificial Sequence
  Synthetic polynucleotide
aatggtctgtgatccccccagcagcagcagcagcagcagcagcagcagcagcagc

SEQ ID NO: 6513 - DNA, 55 bp, Artificial Sequence
  Synthetic polynucleotide
agaaatggtctgtgatccccccagcagcagcagcagcagcagcagcagcagcagc

SEQ ID NO: 6514 - DNA, 55 bp, Artificial Sequence
  Synthetic polynucleotide
gaaagaaatggtctgtgatccccccagcagcagcagcagcagcagcagcagcagc

SEQ ID NO: 6515 - DNA, 55 bp, Artificial Sequence
  Synthetic polynucleotide
cccggcgccagtttgctgctgctgcagcagcagcagcagcagcagcagcagcagc

SEQ ID NO: 6516 - DNA, 55 bp, Artificial Sequence
  Synthetic polynucleotide
agggggcgtgcggcagcgcggcggcggcggcggcggcggcggcggcggaggcggc

SEQ ID NO: 6517 - DNA, 55 bp, Artificial Sequence
  Synthetic polynucleotide
gccagggggcgtgcggcagcgcggcggcggcggcggcggcggcggcggcggaggc

SEQ ID NO: 6518 - DNA, 55 bp, Artificial Sequence
  Synthetic polynucleotide
gctgccagggggcgtgcggcagcgcggcggcggcggcggcggcggcggcggcgga

SEQ ID NO: 6519 - DNA, 55 bp, Artificial Sequence
  Synthetic polynucleotide
ttagtggtgtcatttagtgctgctctatgccagcatttcctgcaaatgagaaatt

SEQ ID NO: 6520 - DNA, 55 bp, Artificial Sequence
  Synthetic polynucleotide
ttctcatttgcaggaaatgctggcatagagcagcactaaatgacaccactaaaga

SEQ ID NO: 6521 - DNA, 55 bp, Artificial Sequence
  Synthetic polynucleotide
aatttctcatttgcaggaaatgctggcatagagcagcactaaatgacaccactaa

SEQ ID NO: 6522 - DNA, 55 bp, Artificial Sequence
  Synthetic polynucleotide
taatttctcatttgcaggaaatgctggcatagagcagcactaaatgacaccacta

SEQ ID NO: 6523 - DNA, 55 bp, Artificial Sequence
  Synthetic polynucleotide
ctaatttctcatttgcaggaaatgctggcatagagcagcactaaatgacaccact

SEQ ID NO: 6524 - DNA, 55 bp, Artificial Sequence
  Synthetic polynucleotide
tggttctaatttctcatttgcaggaaatgctggcatagagcagcactaaatgaca

SEQ ID NO: 6525 - DNA, 55 bp, Artificial Sequence
  Synthetic polynucleotide
aagtttccaaactaacatcacaaggtgataaggtgatattttagaaactttctcc

SEQ ID NO: 6526 - DNA, 55 bp, Artificial Sequence
  Synthetic polynucleotide
ctcgtcagatttgtccttgcagtcggcagtcggggccaccatcacagcgccagct

SEQ ID NO: 6527 - DNA, 55 bp, Artificial Sequence
  Synthetic polynucleotide
ccccctccttgcaggtccagcaaccaaccacggcatcagcctgcaggagatccca

SEQ ID NO: 6528 - DNA, 55 bp, Artificial Sequence
  Synthetic polynucleotide
caggagccgtacagcttcagcgagccgagccggcccagcaggccatgaggaaggc

SEQ ID NO: 6529 - DNA, 55 bp, Artificial Sequence
  Synthetic polynucleotide
ctctaggagtccctcctacaggaccgaccaaggccaaaagccatggggcactgag

SEQ ID NO: 6530 - DNA, 55 bp, Artificial Sequence
  Synthetic polynucleotide
cgcatgcccagctggtccagctggtccagctggtcccactgctgggcgaggccca

SEQ ID NO: 6531 - DNA, 55 bp, Artificial Sequence
  Synthetic polynucleotide
ggagagaaactgacacagaaaagagaggagaggagagaggtttggggcaggggag

SEQ ID NO: 6532 - DNA, 55 bp, Artificial Sequence
  Synthetic polynucleotide
ttcagtacaattaggtgggcttagatttgtgggcttagatttctactgactacta

SEQ ID NO: 6533 - DNA, 55 bp, Artificial Sequence
  Synthetic polynucleotide
ctcaggggaagctagtatggaggatctgggaggatctgcacccagagatccatgc

SEQ ID NO: 6534 - DNA, 55 bp, Artificial Sequence
  Synthetic polynucleotide
aggaggaggaggaggaggaggaggaggaggaggaggaagaggaggaggctgcagc

SEQ ID NO: 6535 - DNA, 55 bp, Artificial Sequence
  Synthetic polynucleotide
tccttgtcggggggcgggggatggtggtggtggtggtggtggtggtggtggtgct

SEQ ID NO: 6536 - DNA, 55 bp, Artificial Sequence
  Synthetic polynucleotide
cggcgagcggcatgaacatgagcggcatggcggcctgggctcgctgggggacgtg

SEQ ID NO: 6537 - DNA, 55 bp, Artificial Sequence
  Synthetic polynucleotide
gcatgagtatttgtgccacatggctccacatggctccacatgcaagtttgaaaca

SEQ ID NO: 6538 - DNA, 55 bp, Artificial Sequence
  Synthetic polynucleotide
ggtcccaaaagtaaatgttaccaggaggtcaggactattacaacaatccagacac

SEQ ID NO: 6539 - DNA, 55 bp, Artificial Sequence
  Synthetic polynucleotide
ggcccgaaggacgcttgcagccccgggcccgggcccgggcccaggaggcggggga

SEQ ID NO: 6540 - DNA, 55 bp, Artificial Sequence
  Synthetic polynucleotide
aggaggaagaggaagaggaggaggaggaggaggaagaggaggaggtgactgagta

SEQ ID NO: 6541 - DNA, 55 bp, Artificial Sequence
  Synthetic polynucleotide
tggcacagccagcactggcacagccagcactggcacagccagcatcagcaaagcc

SEQ ID NO: 6542 - DNA, 55 bp, Artificial Sequence
  Synthetic polynucleotide
ccaggcggcggcggcgggggcggcggcgggcggccgcgggcatgggcttgggcaa

SEQ ID NO: 6543 - DNA, 55 bp, Artificial Sequence
  Synthetic polynucleotide
gggccagcgagaggccaaagaaacccacccaggaagagcaggcagctgttccctt

SEQ ID NO: 6544 - DNA, 55 bp, Artificial Sequence
  Synthetic polynucleotide
cgtcttccagcggctccgggactgggccccgggactgggccccacggcagacaca

SEQ ID NO: 6545 - DNA, 55 bp, Artificial Sequence
  Synthetic polynucleotide
agacagtgctggaactgacagagacttgtggggtggaggcggctgcagcctccgc

SEQ ID NO: 6546 - DNA, 55 bp, Artificial Sequence
  Synthetic polynucleotide
gactgacttaaacttgatccactgattgattggcaccacgaacttcaaaaggtgg

SEQ ID NO: 6547 - DNA, 55 bp, Artificial Sequence
  Synthetic polynucleotide
ccttggtggagggggtcctgctggtggaggtggaggtggaggtgggagtgaatgt

SEQ ID NO: 6548 - DNA, 55 bp, Artificial Sequence
  Synthetic polynucleotide
tgctctccacgtcgccccggggccgccccggggccgccgacccgggctggagagg

SEQ ID NO: 6549 - DNA, 55 bp, Artificial Sequence
  Synthetic polynucleotide
gaggaagaggaagaagaggaagaagagggaaggggaagaagaagaaggaggagga

SEQ ID NO: 6550 - DNA, 55 bp, Artificial Sequence
  Synthetic polynucleotide
gagcggctgctggaggtgcggaagcggaagcggatcaatgtcctgcccctgggga

SEQ ID NO: 6551 - DNA, 55 bp, Artificial Sequence
  Synthetic polynucleotide
taaaaatggcctgtgtgttaacactagctagggggtcattcaagtgtcagtgtcc

SEQ ID NO: 6552 - DNA, 55 bp, Artificial Sequence
  Synthetic polynucleotide
ttttagatatgaatatcgtgtagagatagatggttcaccagtcctgtaatgatcc

SEQ ID NO: 6553 - DNA, 55 bp, Artificial Sequence
  Synthetic polynucleotide
aggacttgacagtcattactagggaagggaagggaagcctcgtgccgtcattgtg

SEQ ID NO: 6554 - DNA, 55 bp, Artificial Sequence
  Synthetic polynucleotide
gaggagctaaagcagcagccccttggcccttgggtattttgtatcaactgccaaa

SEQ ID NO: 6555 - DNA, 55 bp, Artificial Sequence
  Synthetic polynucleotide
atcgaggtgaagacaaaaggaggatcaaggaggatccaagtacctcatctaccgc

SEQ ID NO: 6556 - DNA, 55 bp, Artificial Sequence
  Synthetic polynucleotide
tggttggagctattttacactcatggttcatggccccagataacaagatcaatga

SEQ ID NO: 6557 - DNA, 55 bp, Artificial Sequence
  Synthetic polynucleotide
tggttaacttcatgtcccaatggatacttatggatacttaaagccttctgtgtca

SEQ ID NO: 6558 - DNA, 55 bp, Artificial Sequence
  Synthetic polynucleotide
gcctcgttgagcgactgggtgcgctggcgctggcgctcgcgcacgttggccagga

SEQ ID NO: 6559 - DNA, 55 bp, Artificial Sequence
  Synthetic polynucleotide
aacttgtcagcagaaaggccttctggattctggcttaatagggtattcactactt

SEQ ID NO: 6560 - DNA, 55 bp, Artificial Sequence
  Synthetic polynucleotide
gcagtccctaggccgtttgagggacaggtgagggacagctgcacagaggtctggg

SEQ ID NO: 6561 - DNA, 55 bp, Artificial Sequence
  Synthetic polynucleotide
gcaagagacggctggagtgtgaggagtgtgaggagtgtggcggcctgggctcccc

SEQ ID NO: 6562 - DNA, 55 bp, Artificial Sequence
  Synthetic polynucleotide
acatgggacgtgtgaactatggtgcatatatggtgcatatatcaacgattttaag

SEQ ID NO: 6563 - DNA, 55 bp, Artificial Sequence
  Synthetic polynucleotide
tgcgggagactcgggagctggagctggagctggaggaggagttgtacgccaagct

SEQ ID NO: 6564 - DNA, 55 bp, Artificial Sequence
  Synthetic polynucleotide
ctcctcctcctcctccgctcggcgcggcggcggcggcggcggcggccattttccg

SEQ ID NO: 6565 - DNA, 55 bp, Artificial Sequence
  Synthetic polynucleotide
gacagaggtgttggcagtggtggcatgaggtggcatgaggaatagtgacaggcac

SEQ ID NO: 6566 - DNA, 55 bp, Artificial Sequence
  Synthetic polynucleotide
ccccgcctcataccagcccgacgagggacgaggaggagcgagcgcgcctggcggg

SEQ ID NO: 6567 - DNA, 55 bp, Artificial Sequence
  Synthetic polynucleotide
acaggggaactagtcacatgattggcagattggcattctgcatgacctgaacagg

SEQ ID NO: 6568 - DNA, 55 bp, Artificial Sequence
  Synthetic polynucleotide
caggctgagctgcgagagctgcggcagctgcggctgcggctcgatcaactcaccg

SEQ ID NO: 6569 - DNA, 55 bp, Artificial Sequence
  Synthetic polynucleotide
gggcgtcctgctcaactccggcatcggcatcggggaaggtaaggccccgcccggc

SEQ ID NO: 6570 - DNA, 55 bp, Artificial Sequence
  Synthetic polynucleotide
tgcggtgggtgggtacaggtcctcctgaacaggtccgactgtgggcaaggccagg

SEQ ID NO: 6571 - DNA, 55 bp, Artificial Sequence
  Synthetic polynucleotide
ggtctccttgttgcccttggtgagcacgctgggtgagcacgctgaccacgccatg

SEQ ID NO: 6572 - DNA, 55 bp, Artificial Sequence
  Synthetic polynucleotide
ccaaatctctcttggtgactgagttgggctgggctcttccagaacaccagagact

SEQ ID NO: 6573 - DNA, 55 bp, Artificial Sequence
  Synthetic polynucleotide
cagcagcagcagcagcagcggcggcggcggcggcagctcctccacaggtacctca

SEQ ID NO: 6574 - DNA, 55 bp, Artificial Sequence
  Synthetic polynucleotide
ctggtgccagacatcatgtgcggggatgcggggatgtctcctgtccagtacacca

SEQ ID NO: 6575 - DNA, 55 bp, Artificial Sequence
  Synthetic polynucleotide
tcattgaatttcattgactatttcattgactgggttttcttcctccttaaccaag

SEQ ID NO: 6576 - DNA, 55 bp, Artificial Sequence
  Synthetic polynucleotide
gtttccctggataaacacagagggagtgagtggctttggcgtcttatggtgaggc

SEQ ID NO: 6577 - DNA, 55 bp, Artificial Sequence
  Synthetic polynucleotide
aaccaggcaagccaggtagcccaggttggttggcctggatttcccttctctcctt

SEQ ID NO: 6578 - DNA, 55 bp, Artificial Sequence
  Synthetic polynucleotide
gcgggcgcgggaagatggcggcagcggcagcggcggcggcggctgcagaacaggt

SEQ ID NO: 6579 - DNA, 55 bp, Artificial Sequence
  Synthetic polynucleotide
tggacatcgtcttcctgctgcggctccgagcggctgggtgagcagaacttccaca

SEQ ID NO: 6580 - DNA, 55 bp, Artificial Sequence
  Synthetic polynucleotide
ctttgccccaagtggcaatggcaatggcaatggctatggcccaggagggacaggc

SEQ ID NO: 6581 - DNA, 55 bp, Artificial Sequence
  Synthetic polynucleotide
tggggcctggcagcttcccccgctttcggtcggatgagcacgcagcccagtccaa

SEQ ID NO: 6582 - DNA, 55 bp, Artificial Sequence
  Synthetic polynucleotide
ggaggaagaagaggaggaagaagaggaaagaggatgaagaggaggaagaagagga

SEQ ID NO: 6583 - DNA, 55 bp, Artificial Sequence
  Synthetic polynucleotide
ccaggcggcggcggcgggggcggcggcaggcggccgcgggcatgggcttgggcaa

SEQ ID NO: 6584 - DNA, 55 bp, Artificial Sequence
  Synthetic polynucleotide
cccgccagcaccagctcgcgcaggctgcgcaggctgcccaggccgcggaacgccg

SEQ ID NO: 6585 - DNA, 55 bp, Artificial Sequence
  Synthetic polynucleotide
cagcaggacgcggaagagcagggagtaagtagggcacggaccccagccgcacggc

SEQ ID NO: 6586 - DNA, 55 bp, Artificial Sequence
  Synthetic polynucleotide
cggcgcggatgctgcggacgccgggacgccgggacgccacggctacgccgccgag

SEQ ID NO: 6587 - DNA, 55 bp, Artificial Sequence
  Synthetic polynucleotide
agcgtctctgaagactgctcagggctactcagggctatcctctcagagtgacatt

SEQ ID NO: 6588 - DNA, 55 bp, Artificial Sequence
  Synthetic polynucleotide
cagccttctctgtctctcttggcagtcagtcggtcttggcagctgttgtaattgc

SEQ ID NO: 6589 - DNA, 55 bp, Artificial Sequence
  Synthetic polynucleotide
ggcctgaaaaccgtgctcctggggctgggctgggctgggccaggatcgccaggtc

SEQ ID NO: 6590 - DNA, 55 bp, Artificial Sequence
  Synthetic polynucleotide
gtccgcgcagcgccccctcgcggtgcggtgcggtccgggactgcgcccctgcgca

SEQ ID NO: 6591 - DNA, 55 bp, Artificial Sequence
  Synthetic polynucleotide
ccgccgtctcgtgcccagccagccagccagagggacacccggcggacgtctggcc

SEQ ID NO: 6592 - DNA, 55 bp, Artificial Sequence
  Synthetic polynucleotide
aaatgtaagaaaaatctgctagaggaaaagaggaacattcaatgtcacctgaaag

SEQ ID NO: 6593 - DNA, 55 bp, Artificial Sequence
  Synthetic polynucleotide
acacctgcgtgccctccgtcagcagcagcaagggcatcatggaggaggatgaggc

SEQ ID NO: 6594 - DNA, 55 bp, Artificial Sequence
  Synthetic polynucleotide
tgcggtggacgatggaggggccggactggaggggccggactcgtcatactcctgc

SEQ ID NO: 6595 - DNA, 55 bp, Artificial Sequence
  Synthetic polynucleotide
ctcgaagctcgccttcagcgccaggatctccggatctcctcctccacctgccgcc

SEQ ID NO: 6596 - DNA, 55 bp, Artificial Sequence
  Synthetic polynucleotide
tttagttcttccacactggcaagtccacactggcaagattgctgttcaccatcct

SEQ ID NO: 6597 - DNA, 55 bp, Artificial Sequence
  Synthetic polynucleotide
ttacaggattgagacggagggggagcaagcaggagctgtggaaatatacgatcga

SEQ ID NO: 6598 - DNA, 55 bp, Artificial Sequence
  Synthetic polynucleotide
accggggaggcagtgtatcgctcccggcccgggaccccgtgcgcaacttgcgcct

SEQ ID NO: 6599 - DNA, 55 bp, Artificial Sequence
  Synthetic polynucleotide
ttgggagaatttaggatctgaatccagtccaggtaactaaagaaaaaaacttttt

SEQ ID NO: 6600 - DNA, 55 bp, Artificial Sequence
  Synthetic polynucleotide
gacccgcagacgctctcgggcattgattgttggccatcctccgctccttctcacg

SEQ ID NO: 6601 - DNA, 55 bp, Artificial Sequence
  Synthetic polynucleotide
cacatcttgccatgatctctggaggaagcgaggaggcggccggccgcactgggag

SEQ ID NO: 6602 - DNA, 55 bp, Artificial Sequence
  Synthetic polynucleotide
ctgtagatctagctgcgccacgggctgggctgggccgggccgggcagggggctac

SEQ ID NO: 6603 - DNA, 55 bp, Artificial Sequence
  Synthetic polynucleotide
ggcggaagctccggcggcggaagctcccggcggcggccacggcggcggccacggc

SEQ ID NO: 6604 - DNA, 55 bp, Artificial Sequence
  Synthetic polynucleotide
ctgggggggctgcggtgccgggggcggcggcggcggcggcggctgctgctgctgc

SEQ ID NO: 6605 - DNA, 55 bp, Artificial Sequence
  Synthetic polynucleotide
tttgttatttaaggtgaagcagcatctatctgggtgtgagagtgaaacaagcgtc

SEQ ID NO: 6606 - DNA, 55 bp, Artificial Sequence
  Synthetic polynucleotide
agacatcgggaagattctgatgtggaatggtggaagatgattcccgaaaggaaat

SEQ ID NO: 6607 - DNA, 55 bp, Artificial Sequence
  Synthetic polynucleotide
gaaggcaagagaaaaagagaggaggaggggaggaggctaaagagaggagcgtaag

SEQ ID NO: 6608 - DNA, 55 bp, Artificial Sequence
  Synthetic polynucleotide
ttcccggcgcaggtactacgagaccgagaccggcagcatcaagccgggtgtgatc

SEQ ID NO: 6609 - DNA, 55 bp, Artificial Sequence
  Synthetic polynucleotide
aggaagcagcggcaggggacgcccggctcgcggctcgggcacactggacgtacct

SEQ ID NO: 6610 - DNA, 55 bp, Artificial Sequence
  Synthetic polynucleotide
ccagcctcatcaaccagaagaagaagaagatggatgctgacctgtcccagctcca

SEQ ID NO: 6611 - DNA, 55 bp, Artificial Sequence
  Synthetic polynucleotide
actgtctcctaaaggaaatgcagcagtatgtggtccattcctccatttcctgtaa

SEQ ID NO: 6612 - DNA, 55 bp, Artificial Sequence
  Synthetic polynucleotide
aaggtaagctgagcttgctcctttctttcttggagggatgaggatcacagagttt

SEQ ID NO: 6613 - DNA, 55 bp, Artificial Sequence
  Synthetic polynucleotide
gggagcagggagtggtactgcgaatggtggtggtggtggtggtggtccggggagc

SEQ ID NO: 6614 - DNA, 55 bp, Artificial Sequence
  Synthetic polynucleotide
ccaaaccttggatacatcccagactagactaggtttaatgtgagaacggaagata

SEQ ID NO: 6615 - DNA, 55 bp, Artificial Sequence
  Synthetic polynucleotide
gcgcggcggcggcggcggcggcggcggcggcggcggcggcatggagcgcagtggc

SEQ ID NO: 6616 - DNA, 55 bp, Artificial Sequence
  Synthetic polynucleotide
gatgctctgggccacgccagggtactactgtgggggtatgggtgaggcaggggag

SEQ ID NO: 6617 - DNA, 55 bp, Artificial Sequence
  Synthetic polynucleotide
gcccaggagcttgccctgggactccagcctgggactccaggctggagctccggtg

SEQ ID NO: 6618 - DNA, 55 bp, Artificial Sequence
  Synthetic polynucleotide
ctggcggcgcgcagaccctccgagcagagcaggcatcgtagtagttcaggaagcc

SEQ ID NO: 6619 - DNA, 55 bp, Artificial Sequence
  Synthetic polynucleotide
gccgtggttaaggagctgtgcacgacgacacgggtgctgggcatggagctggctg

SEQ ID NO: 6620 - DNA, 55 bp, Artificial Sequence
  Synthetic polynucleotide
ctgtgactgcttgtagatggccatggcccatggcgcggacgcgggtgccgggcgg

SEQ ID NO: 6621 - DNA, 55 bp, Artificial Sequence
  Synthetic polynucleotide
atttacctaaaattttgaatggataatgaatggataatcgttcttcttcctgaaa

SEQ ID NO: 6622 - DNA, 55 bp, Artificial Sequence
  Synthetic polynucleotide
ctctgccgccttgcaggggaagaacagaacagggctttctcgtagtcctgcaggg

SEQ ID NO: 6623 - DNA, 55 bp, Artificial Sequence
  Synthetic polynucleotide
ctctgtggaagtgctcagcattggcagcattggagtgaatggagccacccaatcc

SEQ ID NO: 6624 - DNA, 55 bp, Artificial Sequence
  Synthetic polynucleotide
catgttgagtcatgcccttctaaaggttaaaggagctattttttctttggcatca

SEQ ID NO: 6625 - DNA, 55 bp, Artificial Sequence
  Synthetic polynucleotide
aatggtgtggacatctactcgctggtgagctggtgactgaaaacattcagtggcc

SEQ ID NO: 6626 - DNA, 55 bp, Artificial Sequence
  Synthetic polynucleotide
aataatcttctactaatgaatggtagtgaatggtagtgagttgaaaataatgtac

SEQ ID NO: 6627 - DNA, 55 bp, Artificial Sequence
  Synthetic polynucleotide
tgcggtcctgctgtccctggcttttatccctggcttttatcacttacgtggagca

SEQ ID NO: 6628 - DNA, 55 bp, Artificial Sequence
  Synthetic polynucleotide
ataagaagaagaagaagaagaagaagaagaaggacagtgtggacacagtggccat

SEQ ID NO: 6629 - DNA, 55 bp, Artificial Sequence
  Synthetic polynucleotide
tagttgtcaatcagaaggggtaatccagaaggggtaatccaatcaggttcccttc

SEQ ID NO: 6630 - DNA, 55 bp, Artificial Sequence
  Synthetic polynucleotide
acacctttttctgatgtgctttgttctttctggatttcgcaggtcctcaagggca

SEQ ID NO: 6631 - DNA, 55 bp, Artificial Sequence
  Synthetic polynucleotide
cgcctgcccggacggcatgctgctggctgctggccagggacatgaggagctgcct

SEQ ID NO: 6632 - DNA, 55 bp, Artificial Sequence
  Synthetic polynucleotide
gctgctgctgctgctgctgctgctgctcctgggtcccgcgggcgcccgtgcgcag

SEQ ID NO: 6633 - DNA, 55 bp, Artificial Sequence
  Synthetic polynucleotide
ttgtggacgaatacgaccccactatagaagaggtgagcctggcgccgccgtccag

SEQ ID NO: 6634 - DNA, 55 bp, Artificial Sequence
  Synthetic polynucleotide
ccatcaacatggccaggatgggcagcaagcaggagccccagcacgcaggggacca

SEQ ID NO: 6635 - DNA, 55 bp, Artificial Sequence
  Synthetic polynucleotide
gtgcaagcggaaggtgacagtgcctgcctgtggtctctgtgcggagtccaaagcg

SEQ ID NO: 6636 - DNA, 55 bp, Artificial Sequence
  Synthetic polynucleotide
cgccgcgccgagcggaggaggaggaggaggaggcgaggaggagagactgtgagtg

SEQ ID NO: 6637 - DNA, 55 bp, Artificial Sequence
  Synthetic polynucleotide
gcggctgcgatcaccgtgcggcacagctcgtggcacagctcgtcgcacagtggat

SEQ ID NO: 6638 - DNA, 55 bp, Artificial Sequence
  Synthetic polynucleotide
gctggagtcacccttcccagtgaggcaggcaggggtcgttaggggaggtgatacg

SEQ ID NO: 6639 - DNA, 55 bp, Artificial Sequence
  Synthetic polynucleotide
gttgctgttcatgatggctggcatgatggctggcatgacagtgtccatgtacctc

SEQ ID NO: 6640 - DNA, 55 bp, Artificial Sequence
  Synthetic polynucleotide
gacgggatgatctcggtgatgagcagcagcaggaagacggtgagcgacagcagca

SEQ ID NO: 6641 - DNA, 55 bp, Artificial Sequence
  Synthetic polynucleotide
tgcacattcgggtcaactggtagacacaactggtagacagcctcaaagccctggt

SEQ ID NO: 6642 - DNA, 55 bp, Artificial Sequence
  Synthetic polynucleotide
aaaatttttttttatagttatgaggaaatgaggaaaaaaagaggaagagaagatg

SEQ ID NO: 6643 - DNA, 55 bp, Artificial Sequence
  Synthetic polynucleotide
gaccccgactgcgaagatggctcggaggctcggatgagtggccgcagcgctgtag

SEQ ID NO: 6644 - DNA, 55 bp, Artificial Sequence
  Synthetic polynucleotide
tggcagggctgagctggcccggcggcggcccggcggcggcgcggcggccccgtgg

SEQ ID NO: 6645 - DNA, 55 bp, Artificial Sequence
  Synthetic polynucleotide
cggcggcggcggcggcggcggcggcggcggcggcatggagcgcagtggctgggcc

SEQ ID NO: 6646 - DNA, 55 bp, Artificial Sequence
  Synthetic polynucleotide
tggcctgcagctgcagaaggtgactgcagaaggtgactgtcctgggcgtggccac

SEQ ID NO: 6647 - DNA, 55 bp, Artificial Sequence
  Synthetic polynucleotide
aaggcctggttgtccttttgctccaggcaggggttcctggtaatccgggcaaacc

SEQ ID NO: 6648 - DNA, 55 bp, Artificial Sequence
  Synthetic polynucleotide
cctactatctcaatataactggataataactggataacctcatcccactcagaaa

SEQ ID NO: 6649 - DNA, 55 bp, Artificial Sequence
  Synthetic polynucleotide
tgatgatgatgatgatgatgatgatgatgatggttttacagggagatcgagggtt

SEQ ID NO: 6650 - DNA, 55 bp, Artificial Sequence
  Synthetic polynucleotide
tcttgatctcccaggtatttcttgctgtgctggcgatcctcaccatcctcggcgt

SEQ ID NO: 6651 - DNA, 55 bp, Artificial Sequence
  Synthetic polynucleotide
gacaattctcacatggtggagagtggaaggtggagagtggaaggtagacagtgat

SEQ ID NO: 6652 - DNA, 55 bp, Artificial Sequence
  Synthetic polynucleotide
ccatcctctgttgctggtgaagtggttaagtggtttttaatactggcctgggagg

SEQ ID NO: 6653 - DNA, 55 bp, Artificial Sequence
  Synthetic polynucleotide
acctccagaactgaggaatgcagaatgcagcggttgacacggcccccacagctga

SEQ ID NO: 6654 - DNA, 55 bp, Artificial Sequence
  Synthetic polynucleotide
cacgtgccagacacaggagctgtttctttctggcccacgctgggaacgattggga

SEQ ID NO: 6655 - DNA, 55 bp, Artificial Sequence
  Synthetic polynucleotide
ttttaacagattttgcaagaatttatcatcaggatcaaggtagatgtgtatatcg

SEQ ID NO: 6656 - DNA, 55 bp, Artificial Sequence
  Synthetic polynucleotide
agcgggcggcacagcacctccggggggcggcggcggcggcggcagcgccagaagc

SEQ ID NO: 6657 - DNA, 55 bp, Artificial Sequence
  Synthetic polynucleotide
agtgggagcgcgcgggcaggcagacggggggggcgcacggcggccgagcgcacca

SEQ ID NO: 6658 - DNA, 55 bp, Artificial Sequence
  Synthetic polynucleotide
gcgcggcggcggcggcggcggcggcggcggcggcatggagcgcagtggctgggcc

SEQ ID NO: 6659 - DNA, 55 bp, Artificial Sequence
  Synthetic polynucleotide
ctcccgggcccgctgcttcgtgcggctggctggcgctgcgctcctccgcgtacaa

SEQ ID NO: 6660 - DNA, 55 bp, Artificial Sequence
  Synthetic polynucleotide
ctttggggttgcccatgatggcagaggcagaggcagaggacaggttgccaaagct

SEQ ID NO: 6661 - DNA, 55 bp, Artificial Sequence
  Synthetic polynucleotide
gatgcgcacctggcggaggcggcggcgcggcgggggcgctgccactggtgcagga

SEQ ID NO: 6662 - DNA, 55 bp, Artificial Sequence
  Synthetic polynucleotide
tgcaagacaagctgaacattggctgaacattggctaccacggcatggctagggct

SEQ ID NO: 6663 - DNA, 55 bp, Artificial Sequence
  Synthetic polynucleotide
gctaggaatactcaccaccccctggagggagggagggagggatgagcccacagta

SEQ ID NO: 6664 - DNA, 55 bp, Artificial Sequence
  Synthetic polynucleotide
ttctttctttccagacactacaacaacaacaggagtgcaaacttctctacagccg

SEQ ID NO: 6665 - DNA, 55 bp, Artificial Sequence
  Synthetic polynucleotide
tcgcggtgaacctggtactcctgggtctcctgggtcccctgggcctgctggtgcc

SEQ ID NO: 6666 - DNA, 55 bp, Artificial Sequence
  Synthetic polynucleotide
taccgtctctcggcccggcggcacacggcccggcggcacacggcccggcagaaat

SEQ ID NO: 6667 - DNA, 55 bp, Artificial Sequence
  Synthetic polynucleotide
cggcggcggcggcggcggcggcggcggcggcggcagcggccgccacggccacggc

SEQ ID NO: 6668 - DNA, 55 bp, Artificial Sequence
  Synthetic polynucleotide
agcgaacggcggcggcggcggcggcggcggcggcaccatccaggcgggcaccatg

SEQ ID NO: 6669 - DNA, 55 bp, Artificial Sequence
  Synthetic polynucleotide
gctgagctgcgagagctgcggctgcggctgcggctcgatcaactcaccgccaaca

SEQ ID NO: 6670 - DNA, 55 bp, Artificial Sequence
  Synthetic polynucleotide
cggcagggctcagcttgaaggcagcggcggcggcggcggcggcggcggcggcgtg

SEQ ID NO: 6671 - DNA, 55 bp, Artificial Sequence
  Synthetic polynucleotide
gtgtgtgtgtccctgcggcgctaagtaagaaggggagactgaggctgaggctggg

SEQ ID NO: 6672 - DNA, 55 bp, Artificial Sequence
  Synthetic polynucleotide
gtcgttgaaggcggccgggtcgatgtaggtaggcgctgatgtcgatggacgtctc

SEQ ID NO: 6673 - DNA, 55 bp, Artificial Sequence
  Synthetic polynucleotide
ctcttgaggcgccgcgtccggggccggggccggggccggggcgggggccggggcc

SEQ ID NO: 6674 - DNA, 55 bp, Artificial Sequence
  Synthetic polynucleotide
gctcgatgacgtccatcacgtcgtagggcagggccgcaggctctccttgaacttc

SEQ ID NO: 6675 - DNA, 55 bp, Artificial Sequence
  Synthetic polynucleotide
cgccgcgccgagcggaggaggaggaggaggaggaggcgaggaggagagactgtga

SEQ ID NO: 6676 - DNA, 55 bp, Artificial Sequence
  Synthetic polynucleotide
ggctgaactttgcagacgaggacgaggacgaggcccaggccttccgggccctcgt

SEQ ID NO: 6677 - DNA, 55 bp, Artificial Sequence
  Synthetic polynucleotide
gcgtccgaccccagcgacgggcagcggcggcggcggcagcagcagcagcagcagc

SEQ ID NO: 6678 - DNA, 55 bp, Artificial Sequence
  Synthetic polynucleotide
ataaccccggcttcgaggccgaggaggaggaggagggagaggtggaaggggaaga

SEQ ID NO: 6679 - DNA, 55 bp, Artificial Sequence
  Synthetic polynucleotide
accttgatcttggagtcatttttgttgtgttggcagaccttctgaaattttatat

SEQ ID NO: 6680 - DNA, 55 bp, Artificial Sequence
  Synthetic polynucleotide
agcagctccagtgaccgcttgaactggctgtggctgctaagtgtgggcgagcgct

SEQ ID NO: 6681 - DNA, 55 bp, Artificial Sequence
  Synthetic polynucleotide
gacaggcggagcggggcggctggcccgcccgggccctcctggcggacgtcgccga

SEQ ID NO: 6682 - DNA, 55 bp, Artificial Sequence
  Synthetic polynucleotide
ctggattggaaggtaacccaggagaaagtcaggagaaagtgccctggggcatcgt

SEQ ID NO: 6683 - DNA, 55 bp, Artificial Sequence
  Synthetic polynucleotide
tgggctcgggggcccccgctgctggcaggcaggctgagcagtgagcccagttcat

SEQ ID NO: 6684 - DNA, 55 bp, Artificial Sequence
  Synthetic polynucleotide
ggaatggcctgagggtcggcctcagcttttcggcctcagcttttcgcttcctgcc

SEQ ID NO: 6685 - DNA, 55 bp, Artificial Sequence
  Synthetic polynucleotide
ccacagctgccgccgctaccggctcgccaccggctcgccaccatcgccaacttct

SEQ ID NO: 6686 - DNA, 55 bp, Artificial Sequence
  Synthetic polynucleotide
tcagttctgccctgtggcctgctgcctgcctggaccccggaggagccagctacag

SEQ ID NO: 6687 - DNA, 55 bp, Artificial Sequence
  Synthetic polynucleotide
catggtgatcaaacgccccggcaggaagccaggaagcgaaaagctgaggccgacc

SEQ ID NO: 6688 - DNA, 55 bp, Artificial Sequence
  Synthetic polynucleotide
ttgtggacgaatacgaccccactatagaggaggtgagcctggcgccgccgtccag

SEQ ID NO: 6689 - DNA, 55 bp, Artificial Sequence
  Synthetic polynucleotide
gacgaggaggagcgagcgcgcctggcgggcgggcgaggaggaggcgctgcgtcag

SEQ ID NO: 6690 - DNA, 55 bp, Artificial Sequence
  Synthetic polynucleotide
ctctctctctctctctctctctctctctgcaggaacggagctttgactgtaagat

SEQ ID NO: 6691 - DNA, 55 bp, Artificial Sequence
  Synthetic polynucleotide
atggtggccccgactgcaaggacaaatctgaggacaaatctgacgaggaaaactg

SEQ ID NO: 6692 - DNA, 55 bp, Artificial Sequence
  Synthetic polynucleotide
ctcgctgtagcgctcctggctggcgcggcgcggcgcggcaggaagaaccagcgct

SEQ ID NO: 6693 - DNA, 55 bp, Artificial Sequence
  Synthetic polynucleotide
aagtctggatctaaaaatttgctgaagtgaaggggctccgtggctggtaaatctg

SEQ ID NO: 6694 - DNA, 55 bp, Artificial Sequence
  Synthetic polynucleotide
gatctagctgcgccacgggctgggccgggccgggccgggcagggggctaccaccc

SEQ ID NO: 6695 - DNA, 55 bp, Artificial Sequence
  Synthetic polynucleotide
tgctggaacttcagggcccgcagcaacaactggtcacccttctccagggtcagct

SEQ ID NO: 6696 - DNA, 55 bp, Artificial Sequence
  Synthetic polynucleotide
aggaagaggaggaggaggaggaggaggaggaggaaggcgaggacagtggcacttc

SEQ ID NO: 6697 - DNA, 55 bp, Artificial Sequence
  Synthetic polynucleotide
gaggggttggccacacgggccttgacgtacgggccttgacgtgcggccctccggt

SEQ ID NO: 6698 - DNA, 55 bp, Artificial Sequence
  Synthetic polynucleotide
aggtcatccagcaggacaacagatggctgatggctgcatccacactgcctctgag

SEQ ID NO: 6699 - DNA, 55 bp, Artificial Sequence
  Synthetic polynucleotide
agacctacttcctctttggctcttttcttcaggagagcttgcttgttttcaaatt

SEQ ID NO: 6700 - DNA, 55 bp, Artificial Sequence
  Synthetic polynucleotide
gccctttaagaatgcaaccgaagcaggatgcggtgcgggttggcggcctgggcgg

SEQ ID NO: 6701 - DNA, 55 bp, Artificial Sequence
  Synthetic polynucleotide
ggccactcaccgatgacggcattggcgcattggcgatggtgatcttgagccacat

SEQ ID NO: 6702 - DNA, 55 bp, Artificial Sequence
  Synthetic polynucleotide
cggcggcggcggcggctgctgctgctgctgcggcggcggcggcggttgcggggcg

SEQ ID NO: 6703 - DNA, 55 bp, Artificial Sequence
  Synthetic polynucleotide
catccgagccatcttcgcagtcttcgcagtcggggtcgttgtcgcaggcccacag

SEQ ID NO: 6704 - DNA, 55 bp, Artificial Sequence
  Synthetic polynucleotide
aggaggaggaggaggaggaggaggaggaggaggaagaggaggaggctgcagcggc

SEQ ID NO: 6705 - DNA, 55 bp, Artificial Sequence
  Synthetic polynucleotide
cgccacgggctgggccgggccgggcagggcagggggctaccaccccgcgccgcag

SEQ ID NO: 6706 - DNA, 55 bp, Artificial Sequence
  Synthetic polynucleotide
gtctgcgcctctgcggggccacggtcggtcggggcacagcgggcagccccaaggg

SEQ ID NO: 6707 - DNA, 55 bp, Artificial Sequence
  Synthetic polynucleotide
gggcgggggcggtggctggggcggcggcggcggctgctgctgcatccctcgcggg

SEQ ID NO: 6708 - DNA, 55 bp, Artificial Sequence
  Synthetic polynucleotide
ccacaagcctggcccggaacatggacggaccggctctcactggatgaggagcact

SEQ ID NO: 6709 - DNA, 55 bp, Artificial Sequence
  Synthetic polynucleotide
gggcctttggggactctgagtggtgggtgatggtggtggtgctccttcttggggg

SEQ ID NO: 6710 - DNA, 55 bp, Artificial Sequence
  Synthetic polynucleotide
gtccatgtcgtattatgagactgtttgttttggacaccccagagatacagagagt

SEQ ID NO: 6711 - DNA, 55 bp, Artificial Sequence
  Synthetic polynucleotide
agcggcgccgcgcctcgcctcgcctcgcctcgggctctgctctccgccggatcgg

SEQ ID NO: 6712 - DNA, 55 bp, Artificial Sequence
  Synthetic polynucleotide
gtggctttctcagaggcagtgtggacagtgtggatgcagccatctgttgtcctgc

SEQ ID NO: 6713 - DNA, 55 bp, Artificial Sequence
  Synthetic polynucleotide
cccgcggtcacgctacctggcgcggctccctggcgcggctcgcggcgtctgggtt

SEQ ID NO: 6714 - DNA, 55 bp, Artificial Sequence
  Synthetic polynucleotide
tgccatgggcaagtacgtggacaagctacgtggacaagcggctggagcagctcgg

SEQ ID NO: 6715 - DNA, 55 bp, Artificial Sequence
  Synthetic polynucleotide
tcttgttacaagcttaaaaggactatgctatggacacttcgtgccttcggacggc

SEQ ID NO: 6716 - DNA, 55 bp, Artificial Sequence
  Synthetic polynucleotide
cgggggcgcggcgggggcgcggctggggcgcggctgctggagcggtaccgccgcg

SEQ ID NO: 6717 - DNA, 55 bp, Artificial Sequence
  Synthetic polynucleotide
gtgcctgacttacctcacggtgggccttcacggtgggcctcgctggagattttat

SEQ ID NO: 6718 - DNA, 55 bp, Artificial Sequence
  Synthetic polynucleotide
agcctcaagtgggcacacttgaagaaagaaaggaatgacgtcgtggaagcactga

SEQ ID NO: 6719 - DNA, 55 bp, Artificial Sequence
  Synthetic polynucleotide
gctggcccctgcccctgcccctgctgactgaggccactggagcccctggagaagc

SEQ ID NO: 6720 - DNA, 55 bp, Artificial Sequence
  Synthetic polynucleotide
accgagtttgtggccctagtacctacctgatggggcgcgggctgaggcacctggc

SEQ ID NO: 6721 - DNA, 55 bp, Artificial Sequence
  Synthetic polynucleotide
tctaccggcttgggccggggcggtttggggcggtttggggcgcagatagccgtgc

SEQ ID NO: 6722 - DNA, 55 bp, Artificial Sequence
  Synthetic polynucleotide
tcccgctgtgggatgttgtgctgctgctgcaggtaggacttgaccatcttcgcca

SEQ ID NO: 6723 - DNA, 55 bp, Artificial Sequence
  Synthetic polynucleotide
ggtcaactcccgcggccagctgcgaggaggaggaggagttgccccctgaccctag

SEQ ID NO: 6724 - DNA, 55 bp, Artificial Sequence
  Synthetic polynucleotide
gtgggctcccgccgcgagaggttatgggagaggttatgggctcccaggaccaccc

SEQ ID NO: 6725 - DNA, 55 bp, Artificial Sequence
  Synthetic polynucleotide
cacaatcaataaactggagaaaaataggataggagaacggtcagcatcggtgtgg

SEQ ID NO: 6726 - DNA, 55 bp, Artificial Sequence
  Synthetic polynucleotide
ctttttaggatcccctgccttgactggaactggaactggaacaatcaacgtcata

SEQ ID NO: 6727 - DNA, 55 bp, Artificial Sequence
  Synthetic polynucleotide
atactcatctttctttaaacgagaaggagaaggtctagattcaatgtgggtcagg

SEQ ID NO: 6728 - DNA, 55 bp, Artificial Sequence
  Synthetic polynucleotide
ccccgtactcgtacgtggcgctcatcgccgtggcgctcatcgccatggcgatccg

SEQ ID NO: 6729 - DNA, 55 bp, Artificial Sequence
  Synthetic polynucleotide
agtgggaccagctggaccagctgggccagctgggcatgcgcatgcagcacaacct

SEQ ID NO: 6730 - DNA, 55 bp, Artificial Sequence
  Synthetic polynucleotide
ccggaggcggaggtaggctcgggaaggcggcggcggcggcggcggcggcagcggc

SEQ ID NO: 6731 - DNA, 55 bp, Artificial Sequence
  Synthetic polynucleotide
gacctggggcgccgggcgcgatgggcgcgatgggcgcgtagagcgcgccgcccgc

SEQ ID NO: 6732 - DNA, 55 bp, Artificial Sequence
  Synthetic polynucleotide
tcatagaacatatcgaagtcgtcctcactcgggctcggtgctctcctccgtggcc

SEQ ID NO: 6733 - DNA, 55 bp, Artificial Sequence
  Synthetic polynucleotide
gccccacgcactctgcggcaagtccctctgcggcaagtcctcggcccggaagacc

SEQ ID NO: 6734 - DNA, 55 bp, Artificial Sequence
  Synthetic polynucleotide
accccctggtgaacctgggcaagctggacctgggcaagctggtccttcagtaagt

SEQ ID NO: 6735 - DNA, 55 bp, Artificial Sequence
  Synthetic polynucleotide
gtcgtccctgagtcaggcgaccggcggcggcggcggcggcggcgggggaggccag

SEQ ID NO: 6736 - DNA, 55 bp, Artificial Sequence
  Synthetic polynucleotide
acgaaggcctgtgggtgctgagggtgccgagggtgccgtccaccatggtgtggcg

SEQ ID NO: 6737 - DNA, 55 bp, Artificial Sequence
  Synthetic polynucleotide
tcccgccgagggtccacagacagcgggtggtggtggtggtggtggtggtggtggc

SEQ ID NO: 6738 - DNA, 55 bp, Artificial Sequence
  Synthetic polynucleotide
acagcggctgcgatcaccgtgcggcacgtgcggcacagctcgtcgcacagtggat

SEQ ID NO: 6739 - DNA, 55 bp, Artificial Sequence
  Synthetic polynucleotide
cttccaaaccagctctggcacagccagctctggcacagccagcactggcacagcc

SEQ ID NO: 6740 - DNA, 55 bp, Artificial Sequence
  Synthetic polynucleotide
tccagagatgaaaactgctgctgctgcctggggggggtgctggggaagagagcag

SEQ ID NO: 6741 - DNA, 55 bp, Artificial Sequence
  Synthetic polynucleotide
cctggtgggccatgaacacgcgcacgggcacgggcaccaggttgggctcgcagtg

SEQ ID NO: 6742 - DNA, 55 bp, Artificial Sequence
  Synthetic polynucleotide
gtcgcctggatctggaacacgtcagcgggcgggcacgctccgctccgaggtgatg

SEQ ID NO: 6743 - DNA, 55 bp, Artificial Sequence
  Synthetic polynucleotide
cggcggcggcggcggcggcggcggcggcggcggcgctgctcccgggggcgacggg

SEQ ID NO: 6744 - DNA, 55 bp, Artificial Sequence
  Synthetic polynucleotide
caagtttgtggcccgcaactacctggaacctggtaaagaaagagtgtgtgcagcc

SEQ ID NO: 6745 - DNA, 55 bp, Artificial Sequence
  Synthetic polynucleotide
acggccccgcggtcacgctacctggcgacctggcgcggctcgcggcgtctgggtt

SEQ ID NO: 6746 - DNA, 55 bp, Artificial Sequence
  Synthetic polynucleotide
ctttggggactctgagtggtggtgatgtggtggtgctccttcttggggggtgagg

SEQ ID NO: 6747 - DNA, 55 bp, Artificial Sequence
  Synthetic polynucleotide
ggattctccgtgctctggactcgtgctctcgggctaccaggtggagctgcgaggc

SEQ ID NO: 6748 - DNA, 55 bp, Artificial Sequence
  Synthetic polynucleotide
ctttattatttttggatcctaggtagatgatggagtccgagagagactgtcagag

SEQ ID NO: 6749 - DNA, 55 bp, Artificial Sequence
  Synthetic polynucleotide
tgcggtggggcaggcggcggtgcggcggtgcggcggccgcgtgcagatggtgtgc

SEQ ID NO: 6750 - DNA, 55 bp, Artificial Sequence
  Synthetic polynucleotide
cagaggcagctagcatgaagacggtgaagacggtgaagacggttttctcggtggg

SEQ ID NO: 6751 - DNA, 55 bp, Artificial Sequence
  Synthetic polynucleotide
ccccacggctgcggcaggtgcggctgcagcaggtgcggctgcaggaaggtgagct

SEQ ID NO: 6752 - DNA, 55 bp, Artificial Sequence
  Synthetic polynucleotide
ttttgggacccactacatcacagaggctgtgggctgtgcttgggggcatttatga

SEQ ID NO: 6753 - DNA, 55 bp, Artificial Sequence
  Synthetic polynucleotide
tgcctgcgacgacgacgacgacgacaatgacggagtccctgacagtcgggacaac

SEQ ID NO: 6754 - DNA, 55 bp, Artificial Sequence
  Synthetic polynucleotide
actcatcagacagtgaggaggaagaagaggaggaagaagaggaggaggaagagga

SEQ ID NO: 6755 - DNA, 55 bp, Artificial Sequence
  Synthetic polynucleotide
tccctttggtgacgtgggctgggccgggccgggcccaggaagtgaggcggcgctg

SEQ ID NO: 6756 - DNA, 55 bp, Artificial Sequence
  Synthetic polynucleotide
aggcgcaagttgcgcacggggtcccggcccgggagcgatacactgcctccccggt

SEQ ID NO: 6757 - DNA, 55 bp, Artificial Sequence
  Synthetic polynucleotide
tgtgtcccttcaccaatcccagttggtgcttggtgcttcctatgaatggcagagc

SEQ ID NO: 6758 - DNA, 55 bp, Artificial Sequence
  Synthetic polynucleotide
ctcctcctcctccgctcggcgcggcggcggcggcggcggcggcggccattttccg

SEQ ID NO: 6759 - DNA, 55 bp, Artificial Sequence
  Synthetic polynucleotide
ccagacagtcatctaactgaagaggctttgaggctttgaaagtttcagctgctcc

SEQ ID NO: 6760 - DNA, 55 bp, Artificial Sequence
  Synthetic polynucleotide
cagcagcagcagcagcagcagcagcagcagcggcggcggcggcagctcctccaca

SEQ ID NO: 6761 - DNA, 55 bp, Artificial Sequence
  Synthetic polynucleotide
ctgtgtccttacggctgtggagctgacctgtggagctgacctttagcctgacggt

SEQ ID NO: 6762 - DNA, 55 bp, Artificial Sequence
  Synthetic polynucleotide
gagcctggtcccagcgcagcgcagcgcagccggacgcgtctgccggccccctggc

SEQ ID NO: 6763 - DNA, 55 bp, Artificial Sequence
  Synthetic polynucleotide
ggaagtgctctggacgtagtcgccatgccatggaggtaactggaatgatacgcgc

SEQ ID NO: 6764 - DNA, 55 bp, Artificial Sequence
  Synthetic polynucleotide
accaatcattttggtgcatgaggatgcatgaggacatacccatgaaaactgcaga

SEQ ID NO: 6765 - DNA, 55 bp, Artificial Sequence
  Synthetic polynucleotide
aaagtctggatctaaaaattgctgaagtgaaggggctcccgtggctggtaaatct

SEQ ID NO: 6766 - DNA, 55 bp, Artificial Sequence
  Synthetic polynucleotide
acccattcgctcgtataagccaatgttggttggcgttgctcgtctcggggatttc

SEQ ID NO: 6767 - DNA, 55 bp, Artificial Sequence
  Synthetic polynucleotide
tggtggcccagcgaagatgcgaagatgcgaaggtgatttccgggtgggactgagc

SEQ ID NO: 6768 - DNA, 55 bp, Artificial Sequence
  Synthetic polynucleotide
ggcgaggccggcggcgggctcgggctgcggcgggctcgggctgcggcgcggcgct

SEQ ID NO: 6769 - DNA, 55 bp, Artificial Sequence
  Synthetic polynucleotide
gacatctgggcagagctcaggcagaagctgaggcagaagctgatgagtagtggca

SEQ ID NO: 6770 - DNA, 55 bp, Artificial Sequence
  Synthetic polynucleotide
aggcgggtcgggggcggggctgggctgggctggaaggtgagctcgggaacgttgg

SEQ ID NO: 6771 - DNA, 55 bp, Artificial Sequence
  Synthetic polynucleotide
gggtcgcgcaccaggtgcacgatgcgtcgtaggttgagcgcggggtcgctgagca

SEQ ID NO: 6772 - DNA, 55 bp, Artificial Sequence
  Synthetic polynucleotide
taaaatatcaccttgtgatgttagttagtttggaaacttcagatatatgtaaatg

SEQ ID NO: 6773 - DNA, 55 bp, Artificial Sequence
  Synthetic polynucleotide
cccgcggtggtctctgcctgcaggatgagcaggatgagcatcatggcctccagct

SEQ ID NO: 6774 - DNA, 55 bp, Artificial Sequence
  Synthetic polynucleotide
cagcaggccctccagaagaagctgaagggggggacagaggatgaggtggaaaagt

SEQ ID NO: 6775 - DNA, 55 bp, Artificial Sequence
  Synthetic polynucleotide
gtccaagggtagaccaccagcagccgcctaagggtgggaaaatagaccaataggc

SEQ ID NO: 6776 - DNA, 55 bp, Artificial Sequence
  Synthetic polynucleotide
aagaggtgaagagtccagtgaaatggaaaatggagcaaatttcaatcattgaaag

SEQ ID NO: 6777 - DNA, 55 bp, Artificial Sequence
  Synthetic polynucleotide
cagaggtgttggcagtggtggcatgaggggtggcatgaggaatagtgacaggcac

SEQ ID NO: 6778 - DNA, 55 bp, Artificial Sequence
  Synthetic polynucleotide
agcgccctgttctgaaggcaggtgcaaggcaggtgcagcatggctggcttcccca

SEQ ID NO: 6779 - DNA, 55 bp, Artificial Sequence
  Synthetic polynucleotide
agctgaagaagacatggctcacacggcacatggctcacacggcactcggagcagt

SEQ ID NO: 6780 - DNA, 55 bp, Artificial Sequence
  Synthetic polynucleotide
ggggaggccacggtggctgagctggatggatggactggagccagatactgagtat

SEQ ID NO: 6781 - DNA, 55 bp, Artificial Sequence
  Synthetic polynucleotide
ttactttacttcccttaggaaaaaaagacaaggaaaaaaagacaaagaaaaaaaa

SEQ ID NO: 6782 - DNA, 55 bp, Artificial Sequence
  Synthetic polynucleotide
tggccccgactgcaaggacaaatctgactgaggaggaaaactgcggtatgggcgg

SEQ ID NO: 6783 - DNA, 55 bp, Artificial Sequence
  Synthetic polynucleotide
atgagcataactcaggaagaagagaagagctggttgttggtgaatgtgatgcctg

SEQ ID NO: 6784 - DNA, 55 bp, Artificial Sequence
  Synthetic polynucleotide
tggtgtccttcttcacctctccttttaggaaggcttctattgtggctgaggccta

SEQ ID NO: 6785 - DNA, 55 bp, Artificial Sequence
  Synthetic polynucleotide
agctaagaaagagcagcggcagaaaaacagcggcagaaaaactttgtggacctgg

SEQ ID NO: 6786 - DNA, 55 bp, Artificial Sequence
  Synthetic polynucleotide
ggtctcccaggggcagccgggcacgaaggtgggcagccgggcacgaaggtggcca

SEQ ID NO: 6787 - DNA, 55 bp, Artificial Sequence
  Synthetic polynucleotide
caattggtccaccatgttcttcaggctggctggctggcaggtaatgggagtatag

SEQ ID NO: 6788 - DNA, 55 bp, Artificial Sequence
  Synthetic polynucleotide
tgcgttgcagctggggctgcgttgcagctggggctgcgggcggcggggctgggac

SEQ ID NO: 6789 - DNA, 55 bp, Artificial Sequence
  Synthetic polynucleotide
cccccagggcactgtctgaagagctggagctggagctggaattattaccgaattg

SEQ ID NO: 6790 - DNA, 55 bp, Artificial Sequence
  Synthetic polynucleotide
cagtttctggcaggcctcgtgactttttgcaggcctcgtgactttttgcagcaac

SEQ ID NO: 6791 - DNA, 55 bp, Artificial Sequence
  Synthetic polynucleotide
ataccttggcaagatcatacagacagagagaggacctgtcgacagtagttcttcc

SEQ ID NO: 6792 - DNA, 55 bp, Artificial Sequence
  Synthetic polynucleotide
catgtgctcacgtgtgcaatacaggtggtaaggccccctccacccattagcaagc

SEQ ID NO: 6793 - DNA, 55 bp, Artificial Sequence
  Synthetic polynucleotide
ttcagcctcttttttccacttctggatcagaggatcagagtttattctaaattca

SEQ ID NO: 6794 - DNA, 55 bp, Artificial Sequence
  Synthetic polynucleotide
tgctatggagaaggggaaattgcacaagccgggaaattgcacaagccaggaaagg

SEQ ID NO: 6795 - DNA, 55 bp, Artificial Sequence
  Synthetic polynucleotide
agcagggagccagcagaccagggccccaccagggccccgggatgcccaggcacac

SEQ ID NO: 6796 - DNA, 55 bp, Artificial Sequence
  Synthetic polynucleotide
tgtgctactagaactcaaaacactggctgttggctgtttcatggtccattcgtgt

SEQ ID NO: 6797 - DNA, 55 bp, Artificial Sequence
  Synthetic polynucleotide
gaccccaatgatgataccacaggattgggtgggagcagagggtggaggaggtgca

SEQ ID NO: 6798 - DNA, 55 bp, Artificial Sequence
  Synthetic polynucleotide
gacttctcttggtttggttgtcagggccccgggcccccgtggcctgcctggtgag

SEQ ID NO: 6799 - DNA, 55 bp, Artificial Sequence
  Synthetic polynucleotide
ggcctggtaccggccagccagccccggtaccggccagccagccccgaaagcctgc

SEQ ID NO: 6800 - DNA, 55 bp, Artificial Sequence
  Synthetic polynucleotide
aatgctgtaggattcccatcaaacaaacagtggtcaaggactaatgcaccagcag

SEQ ID NO: 6801 - DNA, 55 bp, Artificial Sequence
  Synthetic polynucleotide
gctgcatcttttgccaaagctgttagggttaggtcacttcctgagtatccatcag

SEQ ID NO: 6802 - DNA, 55 bp, Artificial Sequence
  Synthetic polynucleotide
taaaaaatttaaggttcttaaagatgatgtgggattgaaaaaagaagatattgca

SEQ ID NO: 6803 - DNA, 55 bp, Artificial Sequence
  Synthetic polynucleotide
ccagctctcctgggtttgaaggatgcgatgcggtacagctgcttcagctgagcaa

SEQ ID NO: 6804 - DNA, 55 bp, Artificial Sequence
  Synthetic polynucleotide
tctgattccagaatagcttctctatctatctggtaggggaaaatgatattaaata

SEQ ID NO: 6805 - DNA, 55 bp, Artificial Sequence
  Synthetic polynucleotide
gtcagggttccacagaaacatgtacagtacagggccacttctagtttggtctggg

SEQ ID NO: 6806 - DNA, 55 bp, Artificial Sequence
  Synthetic polynucleotide
ggagggcagcgcggggaactggcgcggcgcgggtcgctgaacgctgtcaggtcgg

SEQ ID NO: 6807 - DNA, 55 bp, Artificial Sequence
  Synthetic polynucleotide
tgaggtatgccatgccgtctgcaatctctccggccgtctgcaatctctccggcca

SEQ ID NO: 6808 - DNA, 55 bp, Artificial Sequence
  Synthetic polynucleotide
acattttaaatgtaacaatcttctctggcgtggcgctctagaggagaaagggaca

SEQ ID NO: 6809 - DNA, 55 bp, Artificial Sequence
  Synthetic polynucleotide
tccacgtcgccccggggccgccgacccacccgggctggagagggggatgttgagg

SEQ ID NO: 6810 - DNA, 55 bp, Artificial Sequence
  Synthetic polynucleotide
gtcaccctgacgaatctcatctcacctcactggtaagctacccccaccctcatct

SEQ ID NO: 6811 - DNA, 55 bp, Artificial Sequence
  Synthetic polynucleotide
cgtgggaccatgccaggcacaaaacggtttcggtttcaacatgtcattgagaccc

SEQ ID NO: 6812 - DNA, 55 bp, Artificial Sequence
  Synthetic polynucleotide
ctgagccacctttggaagatgagccacctttggaagagctgggctaccacatcta

SEQ ID NO: 6813 - DNA, 55 bp, Artificial Sequence
  Synthetic polynucleotide
aagtttgcaccataagacttggacttgacttgggttttggaaccttcctctcttc

SEQ ID NO: 6814 - DNA, 55 bp, Artificial Sequence
  Synthetic polynucleotide
caggtccatgaaaaagcagatgacttgggtgggcaaaggtggaaatgaagaaagt

SEQ ID NO: 6815 - DNA, 55 bp, Artificial Sequence
  Synthetic polynucleotide
gagccacaccaggctgctgcggccctgctgcggccctgctgcgcctgcatggcgg

SEQ ID NO: 6816 - DNA, 55 bp, Artificial Sequence
  Synthetic polynucleotide
acaggatctgctgggatgctgggccccgctgggccccacttgaaacggttcctcc

SEQ ID NO: 6817 - DNA, 55 bp, Artificial Sequence
  Synthetic polynucleotide
ccccacagggtggagggtggaacgtggtggagggtggaacgtgcggctgcgtgga

SEQ ID NO: 6818 - DNA, 55 bp, Artificial Sequence
  Synthetic polynucleotide
agagagttctgctacgcggtggaggcagggtggaggcagcgtatgtgaccccagt

SEQ ID NO: 6819 - DNA, 55 bp, Artificial Sequence
  Synthetic polynucleotide
gctcgccggctcccggccaccctggtcccctggtccccgggccccgtacctctcc

SEQ ID NO: 6820 - DNA, 55 bp, Artificial Sequence
  Synthetic polynucleotide
agctactattttcccctcaaaacatcattgtggcgttcattctttgctgccttgg

SEQ ID NO: 6821 - DNA, 55 bp, Artificial Sequence
  Synthetic polynucleotide
ctgctgcagcggctggcagacggggccagacggggccatcgacctctatgccatg

SEQ ID NO: 6822 - DNA, 55 bp, Artificial Sequence
  Synthetic polynucleotide
atgctggtgaaggtgggagaaggtgagagaaggtgaggaggggcagtggagcgtg

SEQ ID NO: 6823 - DNA, 55 bp, Artificial Sequence
  Synthetic polynucleotide
tagaacatatcatctggacccttttccatctggacccttttccagcacaccctgc

SEQ ID NO: 6824 - DNA, 55 bp, Artificial Sequence
  Synthetic polynucleotide
caagaacctcaattttcttgttcatggcggcggcaatttcctgctccaggttctc

SEQ ID NO: 6825 - DNA, 55 bp, Artificial Sequence
  Synthetic polynucleotide
gtagttgatttataccctgatagagtcggtcggtaacaatcttgtaagtttgctg

SEQ ID NO: 6826 - DNA, 55 bp, Artificial Sequence
  Synthetic polynucleotide
tagaactcaaaacactggctgtttcatgcatggtccattcgtgtagttgaaccct

SEQ ID NO: 6827 - DNA, 55 bp, Artificial Sequence
  Synthetic polynucleotide
ccccgtggtgcggtggggcaggcggcggtgcggtggggcaggcggcggtgcggcg

SEQ ID NO: 6828 - DNA, 55 bp, Artificial Sequence
  Synthetic polynucleotide
atcgcggtggggtgtggaaggagtcgccgccggggcctcccagccgcagggcggg

SEQ ID NO: 6829 - DNA, 55 bp, Artificial Sequence
  Synthetic polynucleotide
gggtgtgcagctgcaggacaacggcaggacaggacgtgtaaggcaggtgaggcgg

SEQ ID NO: 6830 - DNA, 55 bp, Artificial Sequence
  Synthetic polynucleotide
caaacttcggggggcggcggcggcggccggcggcaaccagaaaaacagcccggac

SEQ ID NO: 6831 - DNA, 55 bp, Artificial Sequence
  Synthetic polynucleotide
cgaaactggagagggcgatggcgaaggcgaaggcctgcagggcgcacagcgggta

SEQ ID NO: 6832 - DNA, 55 bp, Artificial Sequence
  Synthetic polynucleotide
gccggagccccgctcccggtgccccgctcccggtgccccggggtcccagtgcagg

SEQ ID NO: 6833 - DNA, 55 bp, Artificial Sequence
  Synthetic polynucleotide
gctcaccgggttccgggctaaagaagcccccgggctaaagaagcccccgcgctcc

SEQ ID NO: 6834 - DNA, 55 bp, Artificial Sequence
  Synthetic polynucleotide
ggtgatcgtggccatcatcatcatcatcagcgggctggtgctcctggcccaaggt

SEQ ID NO: 6835 - DNA, 55 bp, Artificial Sequence
  Synthetic polynucleotide
ccagcgctcctagtggccatgcacgtcacgtggcctaccggagacatgagaagaa

SEQ ID NO: 6836 - DNA, 55 bp, Artificial Sequence
  Synthetic polynucleotide
gagacagtctgcgtggtaaacttttgggcgtggtaaacttttgggcagcctggtt

SEQ ID NO: 6837 - DNA, 55 bp, Artificial Sequence
  Synthetic polynucleotide
cttactatatggttctttgagcaaccaacatgggaggtgagagtttaataaaata

SEQ ID NO: 6838 - DNA, 55 bp, Artificial Sequence
  Synthetic polynucleotide
tcgtggctgcgcaccaggaactcggcttctcggcttggtatggcagcagggggcc

SEQ ID NO: 6839 - DNA, 55 bp, Artificial Sequence
  Synthetic polynucleotide
agccagctctgcgtgaacctggagggtgggtggctacaagtgccagtgtgaggaa

SEQ ID NO: 6840 - DNA, 55 bp, Artificial Sequence
  Synthetic polynucleotide
gctgctgcagacccactggacactggacactggacaagtacgggatcctggccga

SEQ ID NO: 6841 - DNA, 55 bp, Artificial Sequence
  Synthetic polynucleotide
attgctagcaccaggaagtcttggaagtcttggctgcccatgatttgatttacag

SEQ ID NO: 6842 - DNA, 55 bp, Artificial Sequence
  Synthetic polynucleotide
gtggtctccccagtggctgggctgcgggtcgggtcatctaccctgccccccgcga

SEQ ID NO: 6843 - DNA, 55 bp, Artificial Sequence
  Synthetic polynucleotide
tgctgctgctgttgcgcagccaccggacaccgggctcacgtcgctcattttgccg

SEQ ID NO: 6844 - DNA, 55 bp, Artificial Sequence
  Synthetic polynucleotide
gacctgtgatctcgctggctgcagggctgcagggctgcaggccttccccggagcc

SEQ ID NO: 6845 - DNA, 55 bp, Artificial Sequence
  Synthetic polynucleotide
agtggaaatcgccttctaccggaaagatgatggtaggagcgggccggggcggggc

SEQ ID NO: 6846 - DNA, 55 bp, Artificial Sequence
  Synthetic polynucleotide
ccagctccgacgacggcagctctccgacgacggcagctggggagccaaggaagtt

SEQ ID NO: 6847 - DNA, 55 bp, Artificial Sequence
  Synthetic polynucleotide
ttgctgataatggaggcctgcgggaagcttgggaagcttttagggtatgcgctgc

SEQ ID NO: 6848 - DNA, 55 bp, Artificial Sequence
  Synthetic polynucleotide
agctcagcgaggtcggcgtggaggcggcggcggcggccaccagcattgccatgtc

SEQ ID NO: 6849 - DNA, 55 bp, Artificial Sequence
  Synthetic polynucleotide
tgtacttctggaagcctctgggctcgggctcggactcggatctggtgcttctccc

SEQ ID NO: 6850 - DNA, 55 bp, Artificial Sequence
  Synthetic polynucleotide
ctttgacccttcacccctggatatatgtatgggcagcagtacaccttcttcaggt

SEQ ID NO: 6851 - DNA, 55 bp, Artificial Sequence
  Synthetic polynucleotide
aaggccttcgtgctgagcagtgtggaagtgtggatgagctggagcagcaaaggga

SEQ ID NO: 6852 - DNA, 55 bp, Artificial Sequence
  Synthetic polynucleotide
ttaaatagcattggatacagagcagggagcaggactcaattctagacccaccaga

SEQ ID NO: 6853 - DNA, 55 bp, Artificial Sequence
  Synthetic polynucleotide
cccagcgcgtgtggccctgcccggcgcgtgtggccctgcccggcgtggacgtgag

SEQ ID NO: 6854 - DNA, 55 bp, Artificial Sequence
  Synthetic polynucleotide
aattggaaattttcaagcttttgatgaatgaggacactggactaccagcccatgc

SEQ ID NO: 6855 - DNA, 55 bp, Artificial Sequence
  Synthetic polynucleotide
tcgggagaggagctggacttgctcaggagctggacttgctcaggggctgcgaggg

SEQ ID NO: 6856 - DNA, 55 bp, Artificial Sequence
  Synthetic polynucleotide
tgaggccgccaggcgggtcgggggcggggcggggctgggctggaaggtgagctcg

SEQ ID NO: 6857 - DNA, 55 bp, Artificial Sequence
  Synthetic polynucleotide
ttttaaagtagtagtgattggctgattgataggagaccttggaaggattggaagc

SEQ ID NO: 6858 - DNA, 55 bp, Artificial Sequence
  Synthetic polynucleotide
cgggcttcacacgccggcatctcaggccgccggcatctcaggccaccaccctcca

SEQ ID NO: 6859 - DNA, 55 bp, Artificial Sequence
  Synthetic polynucleotide
cattcagtggcttggacaccgtcaggtgtcaggtccctgggggcagaagagatat

SEQ ID NO: 6860 - DNA, 55 bp, Artificial Sequence
  Synthetic polynucleotide
tcctcgccccacggctcctcggcctcgcctcggcctctcggctcactatgcgcac

SEQ ID NO: 6861 - DNA, 55 bp, Artificial Sequence
  Synthetic polynucleotide
cccagcacgcagagtggaaggccaggcaggtggaaggccaggcactatggaacag

SEQ ID NO: 6862 - DNA, 55 bp, Artificial Sequence
  Synthetic polynucleotide
cgggtcctgtgccgggagacggggctgctggggctgctggccctgcactcggccg

SEQ ID NO: 6863 - DNA, 55 bp, Artificial Sequence
  Synthetic polynucleotide
tgagaaagttggccttccgctacagacagacgggtaaaagagatctacaacacct

SEQ ID NO: 6864 - DNA, 55 bp, Artificial Sequence
  Synthetic polynucleotide
cgccgccgcccccgaggtccgctgctcccgaggtccgctgctgtgtggatgccgt

SEQ ID NO: 6865 - DNA, 55 bp, Artificial Sequence
  Synthetic polynucleotide
cgctggagcttctgcagctgcagctgcagcaggtgagggctgagccaatggggca

SEQ ID NO: 6866 - DNA, 55 bp, Artificial Sequence
  Synthetic polynucleotide
ctgcttgtgacatttgtggcaaaacatttgcggcaaaacatttgcttgtcagagt

SEQ ID NO: 6867 - DNA, 55 bp, Artificial Sequence
  Synthetic polynucleotide
acgggatgctgttggcaccaggcacggacgggggcagggagtgcatccgcgctcc

SEQ ID NO: 6868 - DNA, 55 bp, Artificial Sequence
  Synthetic polynucleotide
ttctggccctcctggtccccctggtccccctggtcctgctgggaaagaagggctt

SEQ ID NO: 6869 - DNA, 55 bp, Artificial Sequence
  Synthetic polynucleotide
gcgcccagccgaatgcgcgaagcagggcgtgggcgtagagggcatccgcggcggg

SEQ ID NO: 6870 - DNA, 55 bp, Artificial Sequence
  Synthetic polynucleotide
cagtcccagtgtcacagacacagatccatccggcagggctccggcttccacacat

SEQ ID NO: 6871 - DNA, 55 bp, Artificial Sequence
  Synthetic polynucleotide
tatgaggtttgtctccagccttgtctgtctgggtcccatcgatagatggcaaatt

SEQ ID NO: 6872 - DNA, 55 bp, Artificial Sequence
  Synthetic polynucleotide
tcggcggatggacgcgctctcgtaggtggtgggcaccagtcttcgatggagcctg

SEQ ID NO: 6873 - DNA, 55 bp, Artificial Sequence
  Synthetic polynucleotide
acagcctggaggagccatccagcaggaagcaggaagaccaggtccagtagcctgc

SEQ ID NO: 6874 - DNA, 55 bp, Artificial Sequence
  Synthetic polynucleotide
gaaggaggcaatgtatatgcaactggttggtggaaataatgaaggacagttgggg

SEQ ID NO: 6875 - DNA, 55 bp, Artificial Sequence
  Synthetic polynucleotide
acgtgtccctataaacatacggaggagtcgaggagtcggcggcgcgtaaggacag

SEQ ID NO: 6876 - DNA, 55 bp, Artificial Sequence
  Synthetic polynucleotide
ccaaggcgcccacctggatgagacggtccctggatgagacggtctgggagaggcc

SEQ ID NO: 6877 - DNA, 55 bp, Artificial Sequence
  Synthetic polynucleotide
tgtgcctcttctgttccaggtagtggtgatcggtgatcttcctttttctgggctt

SEQ ID NO: 6878 - DNA, 55 bp, Artificial Sequence
  Synthetic polynucleotide
ctttttttattttttccatataagataagatggagacggtcttttcttgtgagtc

SEQ ID NO: 6879 - DNA, 55 bp, Artificial Sequence
  Synthetic polynucleotide
atgctgtgggtgctggcacctgagccgtgctggcacctgagccgtgctgccacct

SEQ ID NO: 6880 - DNA, 55 bp, Artificial Sequence
  Synthetic polynucleotide
cccagagcgcgtgggagcaggaggcctgcctggatggctacagcgtggagtactg

SEQ ID NO: 6881 - DNA, 55 bp, Artificial Sequence
  Synthetic polynucleotide
aggaggaggtggtgcggcgggaggaggcggcgggaggaggcggcggtggacgcgc

SEQ ID NO: 6882 - DNA, 55 bp, Artificial Sequence
  Synthetic polynucleotide
cctcggtaggtcttggacggcggccggccgagggtagacccttcccagccctaac

SEQ ID NO: 6883 - DNA, 55 bp, Artificial Sequence
  Synthetic polynucleotide
tggaggcccggcacgcggtgctggctctgctggctctgctgaaggccatcgtgca

SEQ ID NO: 6884 - DNA, 55 bp, Artificial Sequence
  Synthetic polynucleotide
ctgtggctggaagggcagtggtgagcaagcaggatcggctgagggccaaactgct

SEQ ID NO: 6885 - DNA, 55 bp, Artificial Sequence
  Synthetic polynucleotide
tgcttatctggtgatccggagatcggagatcggcaggactgaggtattcaccgag

SEQ ID NO: 6886 - DNA, 55 bp, Artificial Sequence
  Synthetic polynucleotide
ggtatcccggtatgtcaactggattgattaaggaaaaaacaaagctcacttaatg

SEQ ID NO: 6887 - DNA, 55 bp, Artificial Sequence
  Synthetic polynucleotide
tctgtgcagtgacgagactatctggctggctggagcctgaagttctcttttcagg

SEQ ID NO: 6888 - DNA, 55 bp, Artificial Sequence
  Synthetic polynucleotide
cacaaagaactatagagtgtggtataaatgcggtataaatgcacatgtgcttatc

SEQ ID NO: 6889 - DNA, 55 bp, Artificial Sequence
  Synthetic polynucleotide
ttcctgtgaggcacgaagacatcgataataaggtgggccgggtggaggggcagaa

SEQ ID NO: 6890 - DNA, 55 bp, Artificial Sequence
  Synthetic polynucleotide
gaggaaacctcagaaaaagtagaaaaaaaatggaagtctatgtgatcaagaaatc

SEQ ID NO: 6891 - DNA, 55 bp, Artificial Sequence
  Synthetic polynucleotide
gatttttgcaaatggatcttacagggttacagggttacaggtgatttaggtaact

SEQ ID NO: 6892 - DNA, 55 bp, Artificial Sequence
  Synthetic polynucleotide
ggtcgggcggcgcgggcggcgcgggcggcgcgggcggcgcgggcgccccgggggc

SEQ ID NO: 6893 - DNA, 55 bp, Artificial Sequence
  Synthetic polynucleotide
ccacagcagcggtagcagcagcagcagcagcggcagcagccgcagcccggagggc

SEQ ID NO: 6894 - DNA, 55 bp, Artificial Sequence
  Synthetic polynucleotide
ctcagatgctttcaggatgagactggagactggactctcccagctcgctgtgcag

SEQ ID NO: 6895 - DNA, 55 bp, Artificial Sequence
  Synthetic polynucleotide
gccagagggttcagactcaggatggatggatggatgctcatacacggcagccaca

SEQ ID NO: 6896 - DNA, 55 bp, Artificial Sequence
  Synthetic polynucleotide
cagggggtaaagaggcgctaccaggcgggcgggcgggccacggcgcttctgtacc

SEQ ID NO: 6897 - DNA, 55 bp, Artificial Sequence
  Synthetic polynucleotide
ggaaattgatagaagcagaagatagaagatcggctataaaaaagataatggaaag

SEQ ID NO: 6898 - DNA, 55 bp, Artificial Sequence
  Synthetic polynucleotide
tgcccgtgattctcatggatgagacgctcatggatgagacgctcaagtttgtggc

SEQ ID NO: 6899 - DNA, 55 bp, Artificial Sequence
  Synthetic polynucleotide
ttattacttctctttggctatgaaggttgaaggtatgtgctattcaaccattgac

SEQ ID NO: 6900 - DNA, 55 bp, Artificial Sequence
  Synthetic polynucleotide
cctcttcaagagcatctggaacaacagaacaggtttgtggagtgaccgcccaccc

SEQ ID NO: 6901 - DNA, 55 bp, Artificial Sequence
  Synthetic polynucleotide
tccgctacgacctgctggacctcactcgctcggcaggcagtgcaggagctggtca

SEQ ID NO: 6902 - DNA, 55 bp, Artificial Sequence
  Synthetic polynucleotide
ctctgaacgttcttctcatcatcatcatcgtggatgacctgcgcccctccctggg

SEQ ID NO: 6903 - DNA, 55 bp, Artificial Sequence
  Synthetic polynucleotide
acttcgtggactttgtgttccagcagcacagggcagcacagcagcgaggtcccta

SEQ ID NO: 6904 - DNA, 55 bp, Artificial Sequence
  Synthetic polynucleotide
tttaacccactctgtggaagtgctcagcattggcagcattggagtgaatggagcc

SEQ ID NO: 6905 - DNA, 55 bp, Artificial Sequence
  Synthetic polynucleotide
ggccctcctggatttcctggagaaaggggggggtcagaaaggtgatgaaggacca

SEQ ID NO: 6906 - DNA, 55 bp, Artificial Sequence
  Synthetic polynucleotide
acatatgttttattttacttagacatgacatggttagcaaaagactgtcctgctc

SEQ ID NO: 6907 - DNA, 55 bp, Artificial Sequence
  Synthetic polynucleotide
ttataaaagacggaaggccacgactccccccggtcatccacccctgtgaagggaa

SEQ ID NO: 6908 - DNA, 55 bp, Artificial Sequence
  Synthetic polynucleotide
cgaggtcaggaagatgacgctggaccggaccggagcgagtacaccagcctcatcc

SEQ ID NO: 6909 - DNA, 55 bp, Artificial Sequence
  Synthetic polynucleotide
caccaacagcatgaagactgacaggatggatgggaagccatgttcttaagtgtaa

SEQ ID NO: 6910 - DNA, 55 bp, Artificial Sequence
  Synthetic polynucleotide
agacgttgtcgcagcctggctgccgcagcctggctgccgcgtgttgcaagtgaac

SEQ ID NO: 6911 - DNA, 55 bp, Artificial Sequence
  Synthetic polynucleotide
aaagattgctaagacagcacacaaaaaaaatggatcaaccttaaaggaaactgct

SEQ ID NO: 6912 - DNA, 55 bp, Artificial Sequence
  Synthetic polynucleotide
gtgggggaggggctggtccattcccggggctggtccattcccggagctgggcggc

SEQ ID NO: 6913 - DNA, 55 bp, Artificial Sequence
  Synthetic polynucleotide
cgtccatcgtccttcagcagccttcggtgccggtgcacctggggggagagtggcc

SEQ ID NO: 6914 - DNA, 55 bp, Artificial Sequence
  Synthetic polynucleotide
aagagtgctgcgaatgctataatgagtagttgggtgcaaacggatgtatcgagca

SEQ ID NO: 6915 - DNA, 55 bp, Artificial Sequence
  Synthetic polynucleotide
aacatccccctctccagcccgggtcggcggcggccccggggcgacgtggagagca

SEQ ID NO: 6916 - DNA, 55 bp, Artificial Sequence
  Synthetic polynucleotide
cctctttctcctcaaggaacaatcaatcagtggattatagacataagttctcctt

SEQ ID NO: 6917 - DNA, 55 bp, Artificial Sequence
  Synthetic polynucleotide
gcagtggcagacgctgaagcagaacacacacgggcgttgcccactttgagtatca

SEQ ID NO: 6918 - DNA, 55 bp, Artificial Sequence
  Synthetic polynucleotide
tcagctgggctaggtccaggtgctgggtccaggtgctgggagcccacggtatcgt

SEQ ID NO: 6919 - DNA, 55 bp, Artificial Sequence
  Synthetic polynucleotide
gtctgcgagagggtggcgggctgggccaccaggtgcagcagtgcgatgtcattgt

SEQ ID NO: 6920 - DNA, 55 bp, Artificial Sequence
  Synthetic polynucleotide
gcggccgcaaactgacacctcagggacaaagggacaaagagatctggacagaatc

SEQ ID NO: 6921 - DNA, 55 bp, Artificial Sequence
  Synthetic polynucleotide
cccgactgcaaggacaaatctgacactgcaaggacaaatctgacgaggaaaactg

SEQ ID NO: 6922 - DNA, 55 bp, Artificial Sequence
  Synthetic polynucleotide
ggcctttaaaatatggtgctctttaaaacatggtgctctccagccacccaattct

SEQ ID NO: 6923 - DNA, 55 bp, Artificial Sequence
  Synthetic polynucleotide
caaggtcccaaagggcgcactgctgctgctcggcccccccggctgtgggaagacg

SEQ ID NO: 6924 - DNA, 55 bp, Artificial Sequence
  Synthetic polynucleotide
tccgcctgaagctgcccgcgctgctgctgctggcgctgacggcccgggagtcgtc

SEQ ID NO: 6925 - DNA, 55 bp, Artificial Sequence
  Synthetic polynucleotide
gcagcagcagtggtggatgtggcggagaggaggaagaggaggagaatgaggacct

SEQ ID NO: 6926 - DNA, 55 bp, Artificial Sequence
  Synthetic polynucleotide
cctgcaccttatccaagtaagagaagtaagaggccagccgagaattgagttcctg

SEQ ID NO: 6927 - DNA, 55 bp, Artificial Sequence
  Synthetic polynucleotide
tccagcccgggtcggcggccccggggcgacgggcgacgtggagagcaggctggat

SEQ ID NO: 6928 - DNA, 55 bp, Artificial Sequence
  Synthetic polynucleotide
tttaatcttaattggaggcctgactcactcaggggtaaataccatgtccccactg

SEQ ID NO: 6929 - DNA, 55 bp, Artificial Sequence
  Synthetic polynucleotide
cccctttgacgggggcatctatgtctgcgggggcatctatgtctgcagggccacc

SEQ ID NO: 6930 - DNA, 55 bp, Artificial Sequence
  Synthetic polynucleotide
ccgcaggggtgaactcggcggggaggtgctcggcggggaggtgggcggccagggt

SEQ ID NO: 6931 - DNA, 55 bp, Artificial Sequence
  Synthetic polynucleotide
gtggtgccaatcagtggatcaagtttacagtggatcaagtttaagtcagtcagtt

SEQ ID NO: 6932 - DNA, 55 bp, Artificial Sequence
  Synthetic polynucleotide
ataccccaaggttatggataaatatgaatatggagagttctacggccgagacaga

SEQ ID NO: 6933 - DNA, 55 bp, Artificial Sequence
  Synthetic polynucleotide
caccatcctctgtttttgctgtaggttttgaggttttgccatttctcgctcttgg

SEQ ID NO: 6934 - DNA, 55 bp, Artificial Sequence
  Synthetic polynucleotide
cccgggtggccgcggcgctggacgacggcgcggcgctggacgacggctcggccct

SEQ ID NO: 6935 - DNA, 55 bp, Artificial Sequence
  Synthetic polynucleotide
ctagggtgctcctggtgctgtaggtgctcatggtgctgtaggtgcccctggtcct

SEQ ID NO: 6936 - DNA, 55 bp, Artificial Sequence
  Synthetic polynucleotide
ctgcatcgctgaaagggccttcctgaggaaagggccttcctgaggcacctggtag

SEQ ID NO: 6937 - DNA, 55 bp, Artificial Sequence
  Synthetic polynucleotide
aacagaggcatgaccgccttactgaaatgaaggtttctagttgtgacaagaacac

SEQ ID NO: 6938 - DNA, 55 bp, Artificial Sequence
  Synthetic polynucleotide
gtacacaccgatgatgaagcggcccagaagcggcccaggatcagcatctcaaagg

SEQ ID NO: 6939 - DNA, 55 bp, Artificial Sequence
  Synthetic polynucleotide
gtaggtgcctttggacagcagattcacgaagggctgcagattcacgaagggctgc

SEQ ID NO: 6940 - DNA, 55 bp, Artificial Sequence
  Synthetic polynucleotide
ctcatttcacctgcgctgtggacactgctgtggacactgagaacatccgccgtgt

SEQ ID NO: 6941 - DNA, 55 bp, Artificial Sequence
  Synthetic polynucleotide
gggtgttgcggacggcgacggtgtagtggacggcgatggtgtagtggtcgtgggc

SEQ ID NO: 6942 - DNA, 55 bp, Artificial Sequence
  Synthetic polynucleotide
tgccaacagaagcgatcaggatgaccaccacgggcacggcactgagcttgattcc

SEQ ID NO: 6943 - DNA, 55 bp, Artificial Sequence
  Synthetic polynucleotide
gcgggtgggcgacagcggagtggagctggctggcctgcgccccgctgcgggtggc

SEQ ID NO: 6944 - DNA, 55 bp, Artificial Sequence
  Synthetic polynucleotide
cgaggttcgctacctggtgcgggaggagggaggaccgctaccgcgctgccctggc

SEQ ID NO: 6945 - DNA, 55 bp, Artificial Sequence
  Synthetic polynucleotide
ctgagtgcctgcaggctgacgagtgcctgcaggctgacatctgcctgcacctgaa

SEQ ID NO: 6946 - DNA, 55 bp, Artificial Sequence
  Synthetic polynucleotide
taggcggccgcggcggtggctgctggatactggatacgggaagcctggcactgcg

SEQ ID NO: 6947 - DNA, 55 bp, Artificial Sequence
  Synthetic polynucleotide
gtgtcggtatgatcttgtcctgatggaaaacggaaaacgttgaaacagtcttcca

SEQ ID NO: 6948 - DNA, 55 bp, Artificial Sequence
  Synthetic polynucleotide
agtttccaaactaacatcacaaggtgatcaaggtgatattttagaaactttctcc

SEQ ID NO: 6949 - DNA, 55 bp, Artificial Sequence
  Synthetic polynucleotide
gagctttctgttgctactctcagaaagaaagggaacttttccaggtctgtttgct

SEQ ID NO: 6950 - DNA, 55 bp, Artificial Sequence
  Synthetic polynucleotide
cactacttagcctgtgcaccatgtgtaggtaggtagtcctcacttgaaccatgtc

SEQ ID NO: 6951 - DNA, 55 bp, Artificial Sequence
  Synthetic polynucleotide
ctaccgggggactttaggcagaggctgggctggctataaatggagcttgactcga

SEQ ID NO: 6952 - DNA, 55 bp, Artificial Sequence
  Synthetic polynucleotide
tgaataaaggattttggctttctgtatgtatggcttcggtgtcccgccttctact

SEQ ID NO: 6953 - DNA, 55 bp, Artificial Sequence
  Synthetic polynucleotide
cctactttcccgtggccgacctgtctatcgtggccgacctgtctatcatcgccgc

SEQ ID NO: 6954 - DNA, 55 bp, Artificial Sequence
  Synthetic polynucleotide
ggctccaacctgtgatgaagctgaaggaagagggactggatgtgggcccgatcct

SEQ ID NO: 6955 - DNA, 55 bp, Artificial Sequence
  Synthetic polynucleotide
gtgggtttttaaaaatcgttttagggttttagggtcttactacggagcacatttg

SEQ ID NO: 6956 - DNA, 55 bp, Artificial Sequence
  Synthetic polynucleotide
tgtatgtggacaagaccgaacactacttactggccagcatcctactgaggatttt

SEQ ID NO: 6957 - DNA, 55 bp, Artificial Sequence
  Synthetic polynucleotide
tggtggaggtggaggtggaggtggaggtggaggtgagatgtcttcagctttgtct

SEQ ID NO: 6958 - DNA, 55 bp, Artificial Sequence
  Synthetic polynucleotide
cggccgccgaagcccagcgcgcaggagcagcggtgcgcgcaggagcagcggtgcg

SEQ ID NO: 6959 - DNA, 55 bp, Artificial Sequence
  Synthetic polynucleotide
tcctttttgcccagggggtccttgaatgaatggctccataagctgcaaaagcaag

SEQ ID NO: 6960 - DNA, 55 bp, Artificial Sequence
  Synthetic polynucleotide
ggagtgcgtggagaggctgccggacaggacagggggttggccgcggggttacagg

SEQ ID NO: 6961 - DNA, 55 bp, Artificial Sequence
  Synthetic polynucleotide
ggccaccaagggctgccttcgggccgccttcgggccctggccatgaagttcaaga

SEQ ID NO: 6962 - DNA, 55 bp, Artificial Sequence
  Synthetic polynucleotide
cgatggcggcggcggcggcggcggcagcagcggcagcagcagcgggggctgcggg

SEQ ID NO: 6963 - DNA, 55 bp, Artificial Sequence
  Synthetic polynucleotide
tgatggtggccccgactgcaaggacaaatctggacaaatctgacgaggaaaactg

SEQ ID NO: 6964 - DNA, 55 bp, Artificial Sequence
  Synthetic polynucleotide
tcgaggccgaggaggaggaggaggaggaggtggaaggggaagaaggcggaatggt

SEQ ID NO: 6965 - DNA, 55 bp, Artificial Sequence
  Synthetic polynucleotide
gcggcgcgatggcggcggggctggcgcggctggcgcggctcctgttgctcctcgg

SEQ ID NO: 6966 - DNA, 55 bp, Artificial Sequence
  Synthetic polynucleotide
tcctggccctgctcagcatctgtcagtcagtggagaccacaggccctgctgcggt

SEQ ID NO: 6967 - DNA, 55 bp, Artificial Sequence
  Synthetic polynucleotide
cgcccctcacctttcggcaaggcttcgacgaggcttcgacgagacctcgaaggag

SEQ ID NO: 6968 - DNA, 55 bp, Artificial Sequence
  Synthetic polynucleotide
actgctgacctgcccctactgcgaccgaccggggctacaagcgcttgacatcact

SEQ ID NO: 6969 - DNA, 55 bp, Artificial Sequence
  Synthetic polynucleotide
agagcttgatgaggctgttctcaggatggtagggagatttatatggaaatacatg

SEQ ID NO: 6970 - DNA, 55 bp, Artificial Sequence
  Synthetic polynucleotide
cgactcgatgaaggtgatctcgcagctagctgggcgtcagcctgcgcacgctggc

SEQ ID NO: 6971 - DNA, 55 bp, Artificial Sequence
  Synthetic polynucleotide
ctgcgcctgcccggacggcatgctgcttgctggccagggacatgaggagctgcct

SEQ ID NO: 6972 - DNA, 55 bp, Artificial Sequence
  Synthetic polynucleotide
acggggaccggcgggaccagcaggaccagcaggaccagcgttaccaacagctcca

SEQ ID NO: 6973 - DNA, 55 bp, Artificial Sequence
  Synthetic polynucleotide
tgtcatttatccatttcctgtaagcaagcctggtgagagaagaagaagagatgag

SEQ ID NO: 6974 - DNA, 55 bp, Artificial Sequence
  Synthetic polynucleotide
gccgcgtgcaggaactgtgcgctggtgcgctggtgcgctgcagctgctgggctac

SEQ ID NO: 6975 - DNA, 55 bp, Artificial Sequence
  Synthetic polynucleotide
tgcgtttttctcatcgtacctctcgggtccgggtcgtcgaggatgggaggacata

SEQ ID NO: 6976 - DNA, 55 bp, Artificial Sequence
  Synthetic polynucleotide
agagtcaggagaatttctggatttgcgggcgggcgccttctcccctgtagaaatg

SEQ ID NO: 6977 - DNA, 55 bp, Artificial Sequence
  Synthetic polynucleotide
tgcactatgtattttatgggctaggtcggtcggctgggtattgaccataactgca

SEQ ID NO: 6978 - DNA, 55 bp, Artificial Sequence
  Synthetic polynucleotide
agagaattcataaaaggtataaaatttttaaggtataaaatttttgaaataaaca

SEQ ID NO: 6979 - DNA, 55 bp, Artificial Sequence
  Synthetic polynucleotide
catgagtatttgtgccacatggctcccacatggctccacatgcaagtttgaaaca

SEQ ID NO: 6980 - DNA, 55 bp, Artificial Sequence
  Synthetic polynucleotide
aatgctgggttttggcaggagctgctgggctggcactgctgaagtgtgtggaggc

SEQ ID NO: 6981 - DNA, 55 bp, Artificial Sequence
  Synthetic polynucleotide
ggctccagcgagcgctgggctgtgggcagtgggcagtggaaactgcagccgctgg

SEQ ID NO: 6982 - DNA, 55 bp, Artificial Sequence
  Synthetic polynucleotide
aagttcaaagaactcaggttcggttttaatcggttttaatgccaaacatgatcgg

SEQ ID NO: 6983 - DNA, 55 bp, Artificial Sequence
  Synthetic polynucleotide
ctccagccaggccatgtacagcgagcgagctggggcacttccccttcctccctat

SEQ ID NO: 6984 - DNA, 55 bp, Artificial Sequence
  Synthetic polynucleotide
gcacagcgcagctgggccttccatttagctgggtccttccatttagctgggtcag

SEQ ID NO: 6985 - DNA, 55 bp, Artificial Sequence
  Synthetic polynucleotide
aggggttgctgacacaggcgtcgctgacacaggcgtcatccaggtgacacaggag

SEQ ID NO: 6986 - DNA, 55 bp, Artificial Sequence
  Synthetic polynucleotide
tgctgaaggcctttgtggtggacatgatgatggagcggctgcgcatctcccagaa

SEQ ID NO: 6987 - DNA, 55 bp, Artificial Sequence
  Synthetic polynucleotide
gccggggcgcggccctggtctcggcggcggtggcctgtaagaaggcctgtatgct

SEQ ID NO: 6988 - DNA, 55 bp, Artificial Sequence
  Synthetic polynucleotide
ggggccaggcaagggggcggaggcctggcaagggggcggaggcctgggaggcacc

SEQ ID NO: 6989 - DNA, 55 bp, Artificial Sequence
  Synthetic polynucleotide
gcggcggctgtgccctgcctgtgaggggagcggcgcggcgcagtgggcgccggtg

SEQ ID NO: 6990 - DNA, 55 bp, Artificial Sequence
  Synthetic polynucleotide
aggagggtcagcagggtcagcctggaggcctggaggccatctgggcggcgacgtc

SEQ ID NO: 6991 - DNA, 55 bp, Artificial Sequence
  Synthetic polynucleotide
gttgtagacgcggccctggacgtgggtacgcggccctggacgtgggtgcgcgcca

SEQ ID NO: 6992 - DNA, 55 bp, Artificial Sequence
  Synthetic polynucleotide
agcgcatgttctacatcccgcagagcgcagaggtaaggaagcccgtgcgcctctc

SEQ ID NO: 6993 - DNA, 55 bp, Artificial Sequence
  Synthetic polynucleotide
ctcacgtcgtagcggtgcatgggctgcgcatgggctgcatctgcgctgcgccgtg

SEQ ID NO: 6994 - DNA, 55 bp, Artificial Sequence
  Synthetic polynucleotide
gtgtcggccttggggccgggccgggccggcgggggcagggccgagtagccggggc

SEQ ID NO: 6995 - DNA, 55 bp, Artificial Sequence
  Synthetic polynucleotide
tagagaacgatgggagcagcaggtgtcgatgggagcagcaggtgtcggcagcaga

SEQ ID NO: 6996 - DNA, 55 bp, Artificial Sequence
  Synthetic polynucleotide
cagtgcttgtgcattgcagtgacggatggatgggacaggactgctcagctgacat

SEQ ID NO: 6997 - DNA, 55 bp, Artificial Sequence
  Synthetic polynucleotide
gaggacaaggccacgctggtgctgcagggcaggttgttggtgcgtggccaaggcc

SEQ ID NO: 6998 - DNA, 55 bp, Artificial Sequence
  Synthetic polynucleotide
gccgggaagacagtcgcagtagtagctggctggcaatgagattcttacaggattt

SEQ ID NO: 6999 - DNA, 55 bp, Artificial Sequence
  Synthetic polynucleotide
cccagcaccggctgctccaggaagtcggctcggcgcggcctgttaggggatgaga

SEQ ID NO: 7000 - DNA, 55 bp, Artificial Sequence
  Synthetic polynucleotide
tggccattattgaacttacagatgggtgggtggtatgctgttaaggcccagttag

SEQ ID NO: 7001 - DNA, 55 bp, Artificial Sequence
  Synthetic polynucleotide
gccggcagcagtgacaggaggaacggaggaagggttgcttgaggacagtgctgaa

SEQ ID NO: 7002 - DNA, 55 bp, Artificial Sequence
  Synthetic polynucleotide
ttaccataatgcaacttgacaataaaagaaaggatgattaacctctaccaagata

SEQ ID NO: 7003 - DNA, 55 bp, Artificial Sequence
  Synthetic polynucleotide
cccctcgcggtgcggtccgggactgcggtccgggactgcgcccctgcgcaccgct

SEQ ID NO: 7004 - DNA, 55 bp, Artificial Sequence
  Synthetic polynucleotide
cagatgttctcaatgaacttacgcttggtatggtatgttatcgttggtacagacc

SEQ ID NO: 7005 - DNA, 55 bp, Artificial Sequence
  Synthetic polynucleotide
tcttccccctgcaggagactactggactactggattgaccccaaccaaggctgca

SEQ ID NO: 7006 - DNA, 55 bp, Artificial Sequence
  Synthetic polynucleotide
gcgcgcaggcggtcggcgggcgcagccggtcggcgggcgcagccggcggctccga

SEQ ID NO: 7007 - DNA, 55 bp, Artificial Sequence
  Synthetic polynucleotide
caacactccatttttgtttcctttataatatggccaaggagaactcccccagtgt

SEQ ID NO: 7008 - DNA, 55 bp, Artificial Sequence
  Synthetic polynucleotide
ccgctgcccacagaaagggatggcgcggcgcggccccggctggcatccaactggt

SEQ ID NO: 7009 - DNA, 55 bp, Artificial Sequence
  Synthetic polynucleotide
gcagtcaccatgttgggctttagcattagcagggtgccctccaggtaaacatgat

SEQ ID NO: 7010 - DNA, 55 bp, Artificial Sequence
  Synthetic polynucleotide
gtcttcgcttgggcttgatgagtggtcggtcggttctgcccattcatcttgtggt

SEQ ID NO: 7011 - DNA, 55 bp, Artificial Sequence
  Synthetic polynucleotide
acagggtccttctggtcctgttggtcctgttggtcctgctggtgctgttggccca

SEQ ID NO: 7012 - DNA, 55 bp, Artificial Sequence
  Synthetic polynucleotide
tagggcgcgtgcgccgccaggtgcgggtgcaggtgcgggtgcaggtgcgggtgcg

SEQ ID NO: 7013 - DNA, 55 bp, Artificial Sequence
  Synthetic polynucleotide
gaaacggggccgaaagccggggagtgagtgtggtggcagccgctgccgccgaggc

SEQ ID NO: 7014 - DNA, 55 bp, Artificial Sequence
  Synthetic polynucleotide
catttttggttggcactcttacttacttaccggagccagacaaacactttagcca

SEQ ID NO: 7015 - DNA, 55 bp, Artificial Sequence
  Synthetic polynucleotide
tacgtttcaaagtcctgctgatgctagctagggcttttgatagaggtatccgaag

SEQ ID NO: 7016 - DNA, 55 bp, Artificial Sequence
  Synthetic polynucleotide
tgcgctccagggcgaggagctgggaggagctgggatgtggtaaagggcgtgcgcg

SEQ ID NO: 7017 - DNA, 55 bp, Artificial Sequence
  Synthetic polynucleotide
tttgccatcaaattggggacatgggcttcggggcttcgaggccagcattgcagaa

SEQ ID NO: 7018 - DNA, 55 bp, Artificial Sequence
  Synthetic polynucleotide
gcacccctccacctcctccagccagccagctggatgggctgagcgtgagcctggg

SEQ ID NO: 7019 - DNA, 55 bp, Artificial Sequence
  Synthetic polynucleotide
aacctcggaacggaatactggttgtttgttaggccaaactgcttgaggtcatctg

SEQ ID NO: 7020 - DNA, 55 bp, Artificial Sequence
  Synthetic polynucleotide
tttgccctgtcaggccttcgaggaggtctaaggaggcgcctcccatcctgtaggt

SEQ ID NO: 7021 - DNA, 55 bp, Artificial Sequence
  Synthetic polynucleotide
ttggccaacaaagtggcggccgattgttgttggaggagccagccaaccatcttgt

SEQ ID NO: 7022 - DNA, 55 bp, Artificial Sequence
  Synthetic polynucleotide
tctgagcactcacccagcgagagggccgagagggccgagagggccgtggccacac

SEQ ID NO: 7023 - DNA, 55 bp, Artificial Sequence
  Synthetic polynucleotide
cagtagctggtgtgaaagatgggtccggtccggtccagtccgtcaacatcaaaac

SEQ ID NO: 7024 - DNA, 55 bp, Artificial Sequence
  Synthetic polynucleotide
ctgatatgccaatgtcaaaacggagctgaacggagctgactgcgaccacatttct

SEQ ID NO: 7025 - DNA, 55 bp, Artificial Sequence
  Synthetic polynucleotide
ccaagatatggaagagggagagggaggcgagggagagggaggcaaaggccacgga

SEQ ID NO: 7026 - DNA, 55 bp, Artificial Sequence
  Synthetic polynucleotide
ctcggcgcgcaggcggtcggcgggcgcggtcggcgggcgcagccggcggctccga

SEQ ID NO: 7027 - DNA, 55 bp, Artificial Sequence
  Synthetic polynucleotide
cctgggcatgctgggctgtttctgtggtgacggctgtttctgtggtgacggccgc

SEQ ID NO: 7028 - DNA, 55 bp, Artificial Sequence
  Synthetic polynucleotide
ccgactctccccttcttgctgacgtgctgacggactcctgcagttaccactacaa

SEQ ID NO: 7029 - DNA, 55 bp, Artificial Sequence
  Synthetic polynucleotide
gaccacataccccagccagcagcagcaggcaggagggtcagcagggtcagcctgg

SEQ ID NO: 7030 - DNA, 55 bp, Artificial Sequence
  Synthetic polynucleotide
cattgagggtggctcataccgcgtgtggtgtggtcagacacacgggacctggtgc

SEQ ID NO: 7031 - DNA, 55 bp, Artificial Sequence
  Synthetic polynucleotide
gaagtgctcgtacatttgcttgggagtcatgggagtcattaactggaacatggtc

SEQ ID NO: 7032 - DNA, 55 bp, Artificial Sequence
  Synthetic polynucleotide
aagggttcgtccagttccagaagggcaatagggcaatgtcatggttgtacttatt

SEQ ID NO: 7033 - DNA, 55 bp, Artificial Sequence
  Synthetic polynucleotide
cttcccgcagcccgggaaggggcatgggaaggggcatgggaagggcttctcgccc

SEQ ID NO: 7034 - DNA, 55 bp, Artificial Sequence
  Synthetic polynucleotide
tgttttttgtgggcatggctctctggggcatggctctctggggagcccaccggct

SEQ ID NO: 7035 - DNA, 55 bp, Artificial Sequence
  Synthetic polynucleotide
tcagctccccccaggaggtgaggttgcaggaggtgaggttgcagtaggtgaggac

SEQ ID NO: 7036 - DNA, 55 bp, Artificial Sequence
  Synthetic polynucleotide
gaggattcttcaagcagtgaggaatcagtgaggaagagaagacaggtcttgcagt

SEQ ID NO: 7037 - DNA, 55 bp, Artificial Sequence
  Synthetic polynucleotide
gggacgggggtggctctgtggctggctctgtggctggctctgcagggggccctgc

SEQ ID NO: 7038 - DNA, 55 bp, Artificial Sequence
  Synthetic polynucleotide
gctgctgctgcgccccttggggccaccctggggctgctctccttgcttttccgcc

SEQ ID NO: 7039 - DNA, 55 bp, Artificial Sequence
  Synthetic polynucleotide
cccttccggggtcgccccctgggctcacctgggctcagggttcagcagctccggg

SEQ ID NO: 7040 - DNA, 55 bp, Artificial Sequence
  Synthetic polynucleotide
cagcctctcggcgctgctgctgctgcttgcaggtaccccggatcccctgacttgc

SEQ ID NO: 7041 - DNA, 55 bp, Artificial Sequence
  Synthetic polynucleotide
cctctgtgctctcctacagggtaataatgttggtgctcctggagccaaaggtgct

SEQ ID NO: 7042 - DNA, 55 bp, Artificial Sequence
  Synthetic polynucleotide
ggagtacgtggtccgcctctggtccgcctctggtccgccggctgccgcagcaagt

SEQ ID NO: 7043 - DNA, 55 bp, Artificial Sequence
  Synthetic polynucleotide
agagtccgctgctgtagtcgtgggcagtcgtgggcagccgccggcacataggagg

SEQ ID NO: 7044 - DNA, 55 bp, Artificial Sequence
  Synthetic polynucleotide
gcacgagagatcaggagagcacgagagatcaggaggccaccggcgaggtgggaca

SEQ ID NO: 7045 - DNA, 55 bp, Artificial Sequence
  Synthetic polynucleotide
ctgcaagtcgatatccctcagtacaggagcaggagcaaaccaccttgttatcagc

SEQ ID NO: 7046 - DNA, 55 bp, Artificial Sequence
  Synthetic polynucleotide
cacctgcagccaacatggcagcagccaacatggcagcagccttcggaggcttcct

SEQ ID NO: 7047 - DNA, 55 bp, Artificial Sequence
  Synthetic polynucleotide
atcacagcgccagctggagtggatgccagctggagtggatgcactcgccacttag

SEQ ID NO: 7048 - DNA, 55 bp, Artificial Sequence
  Synthetic polynucleotide
cctcctctgttgctgcagatccgtgggcgtgggcgtgagcgcttcgagatgttcc

SEQ ID NO: 7049 - DNA, 55 bp, Artificial Sequence
  Synthetic polynucleotide
ggtcaggatgcatgggcatgcagggcatgcagggctgccgctccaccacaaaggc

SEQ ID NO: 7050 - DNA, 55 bp, Artificial Sequence
  Synthetic polynucleotide
tcaggctgagcaactgctaaagcaagaaagaggtaagtgtggaaccactagcaca

SEQ ID NO: 7051 - DNA, 55 bp, Artificial Sequence
  Synthetic polynucleotide
gccttacgcgccctacgtggagcccaacactgggccggatcccgccggtatgggc

SEQ ID NO: 7052 - DNA, 55 bp, Artificial Sequence
  Synthetic polynucleotide
tgaaagcactctcgctcattcactccctcccggtgaggctctctgcggggtcttt

SEQ ID NO: 7053 - DNA, 55 bp, Artificial Sequence
  Synthetic polynucleotide
ctaacccgggccacccacctggcggtggggtggatgaagaccacggagcccagga

SEQ ID NO: 7054 - DNA, 55 bp, Artificial Sequence
  Synthetic polynucleotide
ggcgcgcatggcctcgatgtcgtcggccgtcggccgacgaggcgcggcgcacgct

SEQ ID NO: 7055 - DNA, 55 bp, Artificial Sequence
  Synthetic polynucleotide
tgctgcatgcgcatgcccagctggtccagctggtccagctggtcccactgctggg

SEQ ID NO: 7056 - DNA, 55 bp, Artificial Sequence
  Synthetic polynucleotide
gccatggtgatgcgcataggcctgggccctgggccgggaggtgggcgtggcggct

SEQ ID NO: 7057 - DNA, 55 bp, Artificial Sequence
  Synthetic polynucleotide
gcccttgaattggccctacctgaaggctgaaggtccttggccagaccttcatcac

SEQ ID NO: 7058 - DNA, 55 bp, Artificial Sequence
  Synthetic polynucleotide
actgactggacccatgggtgggctatatataggttgccaggccagaattgcttct

SEQ ID NO: 7059 - DNA, 55 bp, Artificial Sequence
  Synthetic polynucleotide
cgtctgcttcaggcacgagcggcgcacgagcggcatacgagctccctgctgggcc

SEQ ID NO: 7060 - DNA, 55 bp, Artificial Sequence
  Synthetic polynucleotide
ggttaaagaaaagatcaagtttttggtttttggaaagtgagattgggaataacac

SEQ ID NO: 7061 - DNA, 55 bp, Artificial Sequence
  Synthetic polynucleotide
cagcagcggtagcagcagcggcagcagcagcggcagcagccgcagcccggagggc

SEQ ID NO: 7062 - DNA, 55 bp, Artificial Sequence
  Synthetic polynucleotide
tttgaagatctcttgtattctaattccctttggcataaggcatagaacatgtcct

SEQ ID NO: 7063 - DNA, 55 bp, Artificial Sequence
  Synthetic polynucleotide
gctggcggcagcgttcgcaggacgggcgacgggccctctggccctggcctcagaa

SEQ ID NO: 7064 - DNA, 55 bp, Artificial Sequence
  Synthetic polynucleotide
tactgctgataggaatatgactatatgactaggtgtgttgctggcctgtcttctc

SEQ ID NO: 7065 - DNA, 55 bp, Artificial Sequence
  Synthetic polynucleotide
cggttttggcgatctcaacagaaggtggtgtggtcatcaccaaggtactgattgg

SEQ ID NO: 7066 - DNA, 55 bp, Artificial Sequence
  Synthetic polynucleotide
tagcggaaaaaggcaccggggtggtggtggtggtggtggtggtggtggtggtggt

SEQ ID NO: 7067 - DNA, 55 bp, Artificial Sequence
  Synthetic polynucleotide
cagaaaatcttagagtgtcccatctgcatctggtaagtcagcacaagagtgtatt

SEQ ID NO: 7068 - DNA, 55 bp, Artificial Sequence
  Synthetic polynucleotide
gtggccccgactgcaaggacaaatctgacaaggacaaatctgacgaggaaaactg

SEQ ID NO: 7069 - DNA, 55 bp, Artificial Sequence
  Synthetic polynucleotide
gagtacgcggccgccactcgagcgtgcgtgcggcccatgtcctggctggcttcca

SEQ ID NO: 7070 - DNA, 55 bp, Artificial Sequence
  Synthetic polynucleotide
cacccccttcttccacaccttcgctggagatggagatgtaagtgatcaaccagcc

SEQ ID NO: 7071 - DNA, 55 bp, Artificial Sequence
  Synthetic polynucleotide
caacctgtccgacctcttccagtgggccgtgggccgtgagccgtgcactgtgctc

SEQ ID NO: 7072 - DNA, 55 bp, Artificial Sequence
  Synthetic polynucleotide
ctcgttgacatcgaaggtctcgatggatgttggagatgacgtcgctgctcagctc

SEQ ID NO: 7073 - DNA, 55 bp, Artificial Sequence
  Synthetic polynucleotide
agagagtaacaggtcctgggcagaaggacccggtcctgggcagaaggacccagta

SEQ ID NO: 7074 - DNA, 55 bp, Artificial Sequence
  Synthetic polynucleotide
gtgcggaagcaggtcgcggcagtggctggctggccgggcagctgctgcccagacc

SEQ ID NO: 7075 - DNA, 55 bp, Artificial Sequence
  Synthetic polynucleotide
acttgctttagaccatctacatagccagcctgggaataatttatagagacttaaa

SEQ ID NO: 7076 - DNA, 55 bp, Artificial Sequence
  Synthetic polynucleotide
atggtttctggagtgaaacagggatctatctggtcctgctcctaccactcataag

SEQ ID NO: 7077 - DNA, 55 bp, Artificial Sequence
  Synthetic polynucleotide
attccacgggagcggctggcggctggcggctggcgtggagtacaccttcagcctg

SEQ ID NO: 7078 - DNA, 55 bp, Artificial Sequence
  Synthetic polynucleotide
gatgctggcacctggagcacctggagcacctggagcccggaggcctggggaactc

SEQ ID NO: 7079 - DNA, 55 bp, Artificial Sequence
  Synthetic polynucleotide
gtgatccatgatgagggacactatatgatgagggacactataaaaaattattcct

SEQ ID NO: 7080 - DNA, 55 bp, Artificial Sequence
  Synthetic polynucleotide
gccttcgccgaccggccggccttcgccgaccggccggccttcgcctccttccgtg

SEQ ID NO: 7081 - DNA, 55 bp, Artificial Sequence
  Synthetic polynucleotide
ggcactgcacccgttcgcggcggacggcggcggacgacacctgccggaccagcca

SEQ ID NO: 7082 - DNA, 55 bp, Artificial Sequence
  Synthetic polynucleotide
caggcggaactgggacttgcgcacgaacatgggcagcgcacgaacatgggcacca

SEQ ID NO: 7083 - DNA, 55 bp, Artificial Sequence
  Synthetic polynucleotide
ctagggttctatgaatggacttcgacttcaaggttaagaagtcacataaatccca

SEQ ID NO: 7084 - DNA, 55 bp, Artificial Sequence
  Synthetic polynucleotide
actgtgatcaactactataccggatggatatggatgcaggtgactccaggggagg

SEQ ID NO: 7085 - DNA, 55 bp, Artificial Sequence
  Synthetic polynucleotide
gaagattaagaggacaagcagattcattcaaggtgatcagttggtccttctcggt

SEQ ID NO: 7086 - DNA, 55 bp, Artificial Sequence
  Synthetic polynucleotide
cctggcctccctcaaggaggttgtggtggtaggtctcgatttccttctccagccg

SEQ ID NO: 7087 - DNA, 55 bp, Artificial Sequence
  Synthetic polynucleotide
ttggaggacccggcgggccacactctgccttggagcctcggctgaagtggctggg

SEQ ID NO: 7088 - DNA, 55 bp, Artificial Sequence
  Synthetic polynucleotide
attcggcgcgcgtgcggcccgccgcgagtgcggcccgccgcgagtgagggttttc

SEQ ID NO: 7089 - DNA, 55 bp, Artificial Sequence
  Synthetic polynucleotide
tctacaatcttctgccgggtggaggtccgcaggagtccggcagtggccgcccgtt

SEQ ID NO: 7090 - DNA, 55 bp, Artificial Sequence
  Synthetic polynucleotide
gtgcgcgggcggcggccggaagggcgcggccggaagggcctcttcatgcggcggc

SEQ ID NO: 7091 - DNA, 55 bp, Artificial Sequence
  Synthetic polynucleotide
cgaagcccagcaccaaggaaaggagcaccaaggaaaggagcaccaggtccggctc

SEQ ID NO: 7092 - DNA, 55 bp, Artificial Sequence
  Synthetic polynucleotide
tatctgggctcggtgctgccgctcgtgcttgggtgctgccgctcgtgcttgggct

SEQ ID NO: 7093 - DNA, 55 bp, Artificial Sequence
  Synthetic polynucleotide
gggggcggcgggcgggatgagtgcggtgtgcggtgtgcggtggagcggcgcggat

SEQ ID NO: 7094 - DNA, 55 bp, Artificial Sequence
  Synthetic polynucleotide
gccctgttctacgccctggagaaggagggagggggaggacagggacggccacgcc

SEQ ID NO: 7095 - DNA, 55 bp, Artificial Sequence
  Synthetic polynucleotide
caggctccagggcgcctgccccggccggccgggcacacctcaaagaagagaaggg

SEQ ID NO: 7096 - DNA, 55 bp, Artificial Sequence
  Synthetic polynucleotide
ctgggagaactggacgggctgcagggtggtgggctgcagggtggtcaggctgctg

SEQ ID NO: 7097 - DNA, 55 bp, Artificial Sequence
  Synthetic polynucleotide
gcgggtccaccctttggcacagcggcacagcggtactgcattcctaatgatgcag

SEQ ID NO: 7098 - DNA, 55 bp, Artificial Sequence
  Synthetic polynucleotide
ctggctgcggtcctgctgtccctaggaccctggcttttatcacttacgtggagca

SEQ ID NO: 7099 - DNA, 55 bp, Artificial Sequence
  Synthetic polynucleotide
gctgagcgggggcaccgcataggggaggggagggaggacacgttgaaccatgcgt

SEQ ID NO: 7100 - DNA, 55 bp, Artificial Sequence
  Synthetic polynucleotide
ttggctgaaaacctactgtccccagaggagaggatatggttctcttccacaacct

SEQ ID NO: 7101 - DNA, 55 bp, Artificial Sequence
  Synthetic polynucleotide
agcacgcgggagcgcatgaggatgcgcatgaggatgcgcatgagggcagaggtca

SEQ ID NO: 7102 - DNA, 55 bp, Artificial Sequence
  Synthetic polynucleotide
cttcccgggcttcctcgccccacggctccacggctcctcggcctcggccgcctcg

SEQ ID NO: 7103 - DNA, 55 bp, Artificial Sequence
  Synthetic polynucleotide
tcccgagtggaaggcgctgctgctctgcgctggtgctctgcgctgctctccggct

SEQ ID NO: 7104 - DNA, 55 bp, Artificial Sequence
  Synthetic polynucleotide
ccctggtgctcctggtgctcctggtgctcctggtgcccctggccccgttggccct

SEQ ID NO: 7105 - DNA, 55 bp, Artificial Sequence
  Synthetic polynucleotide
ccgcagccatgggccgggcccggccgggcccggccgggccaacgcgggccgccca

SEQ ID NO: 7106 - DNA, 55 bp, Artificial Sequence
  Synthetic polynucleotide
agtgtctgcggggacccaggcacttctgcagggacccaggcacttctgcaggaga

SEQ ID NO: 7107 - DNA, 55 bp, Artificial Sequence
  Synthetic polynucleotide
gtgattgcagtactgtcggatttctgctgtcggatttctgtataattgggctgtg

SEQ ID NO: 7108 - DNA, 55 bp, Artificial Sequence
  Synthetic polynucleotide
caggtcacagcggagtgaatcagctcagctcggtggtgtctttgtcaacgggcgg

SEQ ID NO: 7109 - DNA, 55 bp, Artificial Sequence
  Synthetic polynucleotide
gaaggggaagaaggcggaatggtggtggagtggagatggacgtagagtggcgccc

SEQ ID NO: 7110 - DNA, 55 bp, Artificial Sequence
  Synthetic polynucleotide
tgccgctggcgtggctggcgcaggcgggcgtggctggcgcaggcgggcctggcgc

SEQ ID NO: 7111 - DNA, 55 bp, Artificial Sequence
  Synthetic polynucleotide
tcctggcgcggggctggcgcggggctggcgcggggctttttgcaccccgccgcga

SEQ ID NO: 7112 - DNA, 55 bp, Artificial Sequence
  Synthetic polynucleotide
agcatgtccttggggccctgggggaagcctgggggaagccagggggaagccagga

SEQ ID NO: 7113 - DNA, 55 bp, Artificial Sequence
  Synthetic polynucleotide
actattttgtgggctttctttccgaggccgaggccacggccacgttggcgggggc

SEQ ID NO: 7114 - DNA, 55 bp, Artificial Sequence
  Synthetic polynucleotide
attcagatcacatgaccttcctgcagccagcgggtgaagaacatgctcattgcct

SEQ ID NO: 7115 - DNA, 55 bp, Artificial Sequence
  Synthetic polynucleotide
tcattgttcgctgaaggggaaggctcgaaggggaaggctcgcaagcgatgtagat

SEQ ID NO: 7116 - DNA, 55 bp, Artificial Sequence
  Synthetic polynucleotide
agtttgtaggacgttgccaaagtagtcagtcggcttctgaaaacttgatctgaat

SEQ ID NO: 7117 - DNA, 55 bp, Artificial Sequence
  Synthetic polynucleotide
gatgcactcacagggcagcgatgcactcacagggcagcgattacctggacatcgg

SEQ ID NO: 7118 - DNA, 55 bp, Artificial Sequence
  Synthetic polynucleotide
tgaaaggaatccgtttcataggaaatgggtgggtattgtaaatttcccagctcca

SEQ ID NO: 7119 - DNA, 55 bp, Artificial Sequence
  Synthetic polynucleotide
tcccccatgcctcccgagttctgggagggaagggtcgatgctggagaagccggcc

SEQ ID NO: 7120 - DNA, 55 bp, Artificial Sequence
  Synthetic polynucleotide
gctgacatccttggccatgctgatgttggttggatagcttctataggagcattga

SEQ ID NO: 7121 - DNA, 55 bp, Artificial Sequence
  Synthetic polynucleotide
gcctcttaacaatggtcttgtgaagggtgaaggctttcagcagcctaaacacaaa

SEQ ID NO: 7122 - DNA, 55 bp, Artificial Sequence
  Synthetic polynucleotide
cgctggaactgctccgcgcttgagggcggagggcggcggccgcctgccgcaccac

SEQ ID NO: 7123 - DNA, 55 bp, Artificial Sequence
  Synthetic polynucleotide
gctgggagaagtgggagctggacctggacctggacatcaaggaggtcttcgtcca

SEQ ID NO: 7124 - DNA, 55 bp, Artificial Sequence
  Synthetic polynucleotide
tccaccttcgtgggcaaggtgtggcgggcaaggtgtggctcacggtgctggtggt

SEQ ID NO: 7125 - DNA, 55 bp, Artificial Sequence
  Synthetic polynucleotide
accctcaaggtgttccaggacagcaaggcaaggcctgggagaacttccgcaccct

SEQ ID NO: 7126 - DNA, 55 bp, Artificial Sequence
  Synthetic polynucleotide
tacagtcctcagcaaggtgcaggtgggtgcaggtgggtggagtactaggaaaaag

SEQ ID NO: 7127 - DNA, 55 bp, Artificial Sequence
  Synthetic polynucleotide
gctggctcctccggggtccaggcagcaggcaggccacagggcagaactgaccatc

SEQ ID NO: 7128 - DNA, 55 bp, Artificial Sequence
  Synthetic polynucleotide
cctgagtctgctctttccccgtgccaggcagggcccgggcggccagcgagcaggc

SEQ ID NO: 7129 - DNA, 55 bp, Artificial Sequence
  Synthetic polynucleotide
gagtttcccgctgtctccagcggtgcggtgcgggtgaagctggtgtctgcggggt

SEQ ID NO: 7130 - DNA, 55 bp, Artificial Sequence
  Synthetic polynucleotide
tgcggcggaggcgggggtgcggccgaggcgggggtgcggccggcgggcctcccag

SEQ ID NO: 7131 - DNA, 55 bp, Artificial Sequence
  Synthetic polynucleotide
cacggctggccgtaggcggcgggcggcgcgcggcgcggcggcgtagggcagcgcc

SEQ ID NO: 7132 - DNA, 55 bp, Artificial Sequence
  Synthetic polynucleotide
ggaggcagaccaggaacagcaggagggagccggtgggtagcccagagccggagtc

SEQ ID NO: 7133 - DNA, 55 bp, Artificial Sequence
  Synthetic polynucleotide
catgcgctgtgaccgcaagatggaggtgggaggtggcgttcatggtgtgtgccat

SEQ ID NO: 7134 - DNA, 55 bp, Artificial Sequence
  Synthetic polynucleotide
ctggaaggcctcgttcctccgagctggagctggcgtctaccccgagaaggaccag

SEQ ID NO: 7135 - DNA, 55 bp, Artificial Sequence
  Synthetic polynucleotide
ccctcggcctgtgacgcctcgctggagggctggagaagcagggcgagatccctga

SEQ ID NO: 7136 - DNA, 55 bp, Artificial Sequence
  Synthetic polynucleotide
tgtgggggctggcggagctgctggagctgctggagctcgacctgacctccaacca

SEQ ID NO: 7137 - DNA, 55 bp, Artificial Sequence
  Synthetic polynucleotide
cggctgcagcagctgcggctgcagcagctgcggctgcagccgcgggccccggtag

SEQ ID NO: 7138 - DNA, 55 bp, Artificial Sequence
  Synthetic polynucleotide
caggactcccctcttgcctgcagggcaggccggtattaccgcaccaaccacactg

SEQ ID NO: 7139 - DNA, 55 bp, Artificial Sequence
  Synthetic polynucleotide
gccagctgaaaaggggctctgtggacagacaggatgagaggcctggaccccagca

SEQ ID NO: 7140 - DNA, 55 bp, Artificial Sequence
  Synthetic polynucleotide
aagaccatcagtgcgaggtcggcatgaggtcggcatgatcgtgggtaagggctcc

SEQ ID NO: 7141 - DNA, 55 bp, Artificial Sequence
  Synthetic polynucleotide
ttcagcagcttctgctttgctttgctttgccggagaggctgaaggcgccatcctg

SEQ ID NO: 7142 - DNA, 55 bp, Artificial Sequence
  Synthetic polynucleotide
tacggggagctgtggctgcagctgtctgctgggctcctcgggaggcctgaaattt

SEQ ID NO: 7143 - DNA, 55 bp, Artificial Sequence
  Synthetic polynucleotide
gactggccggtgcactcaaagggcactcaaagggcgctcactgtgggccaggatg

SEQ ID NO: 7144 - DNA, 55 bp, Artificial Sequence
  Synthetic polynucleotide
gttctgcagatgtggtcggttctgcagatgtggtcggtcctgcaggacggtccca

SEQ ID NO: 7145 - DNA, 55 bp, Artificial Sequence
  Synthetic polynucleotide
tcctcagtttgtggtctgccagctaaataaaggtgaagatatattcctccaattc

SEQ ID NO: 7146 - DNA, 55 bp, Artificial Sequence
  Synthetic polynucleotide
ggctactatcccaacgaccatacccgtccgtggtgctgctggactcccggatcac

SEQ ID NO: 7147 - DNA, 55 bp, Artificial Sequence
  Synthetic polynucleotide
aggcagttattttggagggaaagtagagagaggctcagcccaaaggtatccactt

SEQ ID NO: 7148 - DNA, 55 bp, Artificial Sequence
  Synthetic polynucleotide
taccaaaacattctagcggccatcgagggagggctccaggttctacacctcggac

SEQ ID NO: 7149 - DNA, 55 bp, Artificial Sequence
  Synthetic polynucleotide
gcaggtggtagactctcgttctctcaggacaggacagatgctctcctcggggagt

SEQ ID NO: 7150 - DNA, 55 bp, Artificial Sequence
  Synthetic polynucleotide
tccctaaaagcttcggctacagctacagctcggtggtgtgtgtctgcaatgccac

SEQ ID NO: 7151 - DNA, 55 bp, Artificial Sequence
  Synthetic polynucleotide
gacctcggtggccagggccctgcgcgtgtagggctctgcgcgtgtagggctctgc

SEQ ID NO: 7152 - DNA, 55 bp, Artificial Sequence
  Synthetic polynucleotide
tagccagctctgcttggagcagggggtgcttggagcagggggaagtcgtagcggt

SEQ ID NO: 7153 - DNA, 55 bp, Artificial Sequence
  Synthetic polynucleotide
attccaattacctggacttccagctggtggtggtgagtccttcctgctgtcagtg

SEQ ID NO: 7154 - DNA, 55 bp, Artificial Sequence
  Synthetic polynucleotide
gcgccgaggaggagatggaggccgggaggccgggcggccgcggcccgtgctgcgc

SEQ ID NO: 7155 - DNA, 55 bp, Artificial Sequence
  Synthetic polynucleotide
ccacgatacctgcgtggcacgatacctgcgtggctggggctgcgggctccggggt

SEQ ID NO: 7156 - DNA, 55 bp, Artificial Sequence
  Synthetic polynucleotide
tcctggacctcctggtccccctggtccccctggtcctcccagcgctggtttcgac

SEQ ID NO: 7157 - DNA, 55 bp, Artificial Sequence
  Synthetic polynucleotide
caggagacagctgaacagccaggtagcgagcggcacctgaagaaagcaggcaatt

SEQ ID NO: 7158 - DNA, 55 bp, Artificial Sequence
  Synthetic polynucleotide
cttcttccgccggttggtctgttgtgactcaggtctgttgtgactcaagtctgta

SEQ ID NO: 7159 - DNA, 55 bp, Artificial Sequence
  Synthetic polynucleotide
cacacacagtagggggtgcagggccggccgaggagtccagccctggcagcggggc

SEQ ID NO: 7160 - DNA, 55 bp, Artificial Sequence
  Synthetic polynucleotide
aggcttcagcaccagcgattacgacgacgttggctgggagagtcctcacaatggc

SEQ ID NO: 7161 - DNA, 55 bp, Artificial Sequence
  Synthetic polynucleotide
ccgtgccacaggtggcggtgttgtacgtggcggtgttgtacttggcgtgcaggct

SEQ ID NO: 7162 - DNA, 55 bp, Artificial Sequence
  Synthetic polynucleotide
acctacagcctgggcggcggcggcgcggcgcggcgcgcgtgcgggtgcgcggctc

SEQ ID NO: 7163 - DNA, 55 bp, Artificial Sequence
  Synthetic polynucleotide
gctgacaatctatctgaaaaattggaaaattggaaaggtatgttcatgtacattg

SEQ ID NO: 7164 - DNA, 55 bp, Artificial Sequence
  Synthetic polynucleotide
ctgggagaactggacgggctgcagggctgcagggctgccaggctgccggccacac

SEQ ID NO: 7165 - DNA, 55 bp, Artificial Sequence
  Synthetic polynucleotide
aggtgttgaggtcggcgcagacactgggttgggtccaaatctatttcagagaaag

SEQ ID NO: 7166 - DNA, 55 bp, Artificial Sequence
  Synthetic polynucleotide
ccatcctctcttttagcctccacaggcgagcggctcctctccacttggcttttcc

SEQ ID NO: 7167 - DNA, 55 bp, Artificial Sequence
  Synthetic polynucleotide
gacactgaaactttacgtaaatcgtaaatgtgggtgctgttgtgatgaggaaatc

SEQ ID NO: 7168 - DNA, 55 bp, Artificial Sequence
  Synthetic polynucleotide
acctgtccccagcggcggcggcagcggcggcggcggcggctgcggcggcggcggc

SEQ ID NO: 7169 - DNA, 55 bp, Artificial Sequence
  Synthetic polynucleotide
gttgcccaggaagccgcagacgtcggccgtcggccccgaccagaggcacccccag

SEQ ID NO: 7170 - DNA, 55 bp, Artificial Sequence
  Synthetic polynucleotide
cctcagtcaagttggaaacagtctagtctttggtgtaatcctgaaataaaaaagc

SEQ ID NO: 7171 - DNA, 55 bp, Artificial Sequence
  Synthetic polynucleotide
ttttgttgagacactggatatttgagccactggatatttgagcctggatatgagt

SEQ ID NO: 7172 - DNA, 55 bp, Artificial Sequence
  Synthetic polynucleotide
gttgaaggcgccggcggtggggcggtggggcggtggcgcaggtcaatgaggatgt

SEQ ID NO: 7173 - DNA, 55 bp, Artificial Sequence
  Synthetic polynucleotide
tttactcacacatccgttggacacctccgttggacacctgcataggggaagtgga

SEQ ID NO: 7174 - DNA, 55 bp, Artificial Sequence
  Synthetic polynucleotide
taccagctgaccttgtgggggccagccagaaggcaacatcctggactatgccaac

SEQ ID NO: 7175 - DNA, 55 bp, Artificial Sequence
  Synthetic polynucleotide
ggggggccttccggatgtagatcttccaccaggtggaggagtcggggttctcggc

SEQ ID NO: 7176 - DNA, 55 bp, Artificial Sequence
  Synthetic polynucleotide
caatcgggacagctttgataccactcggctcggcagaggctggtgctggagattg

SEQ ID NO: 7177 - DNA, 55 bp, Artificial Sequence
  Synthetic polynucleotide
ccatggggaactgggctgtgaatgagggaggggctctccatttttgtcattgtaa

SEQ ID NO: 7178 - DNA, 55 bp, Artificial Sequence
  Synthetic polynucleotide
cgcagggtgtagcggagggcgcggggcgcggggccgggcgccgccagcggcgtgc

SEQ ID NO: 7179 - DNA, 55 bp, Artificial Sequence
  Synthetic polynucleotide
ctgaatcccttgcaggtatgtcctatgtcctggatgatgaatacacaagctcagt

SEQ ID NO: 7180 - DNA, 55 bp, Artificial Sequence
  Synthetic polynucleotide
atatttccatcttctgtgaaatgtttgtttaggaggcagaatgtgtgagcgcaag

SEQ ID NO: 7181 - DNA, 55 bp, Artificial Sequence
  Synthetic polynucleotide
gcagcggcagtggcgggggcggcggcggggcggcggcagctctggcgggggcagc

SEQ ID NO: 7182 - DNA, 55 bp, Artificial Sequence
  Synthetic polynucleotide
agggagcaggaggaggtgggggctggggcgtgggggctggggcttggggccacag

SEQ ID NO: 7183 - DNA, 55 bp, Artificial Sequence
  Synthetic polynucleotide
aatccggtacaacagtgatctacagtgatctggttcagaaatatcacccttgctt

SEQ ID NO: 7184 - DNA, 55 bp, Artificial Sequence
  Synthetic polynucleotide
tagtgttggcctgagaaggttgccccgagaaggttgccccatgtccaggctcatg

SEQ ID NO: 7185 - DNA, 55 bp, Artificial Sequence
  Synthetic polynucleotide
caggctctggcagaaggcagctggcggggaaggcagctggcggggaaaacaccgg

SEQ ID NO: 7186 - DNA, 55 bp, Artificial Sequence
  Synthetic polynucleotide
cagagactgaaggatgacgctcctgaggccaggccgtgacagaggagcaggcaga

SEQ ID NO: 7187 - DNA, 55 bp, Artificial Sequence
  Synthetic polynucleotide
tattcttaattccacatctttctgtataaatggctcatctgtataaatggctcat

SEQ ID NO: 7188 - DNA, 55 bp, Artificial Sequence
  Synthetic polynucleotide
ggcctatgagctgctgccggcactggacactggacgaggtgctggctagtgacag

SEQ ID NO: 7189 - DNA, 55 bp, Artificial Sequence
  Synthetic polynucleotide
aaatgagccttctgctgggctgttgatgagtggataccccttccagtgcctgggc

SEQ ID NO: 7190 - DNA, 55 bp, Artificial Sequence
  Synthetic polynucleotide
cctgtgccgcgccggaacagcacggaatcccggaatcctcctgctccgggacgcc

SEQ ID NO: 7191 - DNA, 55 bp, Artificial Sequence
  Synthetic polynucleotide
aatgatatactaaaggaatttatgaatttatggttcgaaatacatacatttttcc

SEQ ID NO: 7192 - DNA, 55 bp, Artificial Sequence
  Synthetic polynucleotide
ggtgttcaccacatcaagcgccgggacatcgggacatcgtgctcaagtgggagct

SEQ ID NO: 7193 - DNA, 55 bp, Artificial Sequence
  Synthetic polynucleotide
cctcgggctgcactaccccccgcggaagagcggaagatgaggctggagacgcagc

SEQ ID NO: 7194 - DNA, 55 bp, Artificial Sequence
  Synthetic polynucleotide
gttgcactggaagctggcgggaccacacacaggtgagcaccgggcaggaggcctc

SEQ ID NO: 7195 - DNA, 55 bp, Artificial Sequence
  Synthetic polynucleotide
ggcctggactcgggggagctgcagtccgtccggcccggagtcgaggtgactgcac

SEQ ID NO: 7196 - DNA, 55 bp, Artificial Sequence
  Synthetic polynucleotide
actgtctgggtgtgctcactctgccaggccagggcctgcggtccaatgtcctctt

SEQ ID NO: 7197 - DNA, 55 bp, Artificial Sequence
  Synthetic polynucleotide
ccaagcaccacaaggaaaagccaggccccaaggaaaagccaggccccgaggacaa

SEQ ID NO: 7198 - DNA, 55 bp, Artificial Sequence
  Synthetic polynucleotide
gaggacagggcttatggcagaattggccattggccatcatgatgcaggccttcca

SEQ ID NO: 7199 - DNA, 55 bp, Artificial Sequence
  Synthetic polynucleotide
agcacctaccttcagctcctgcatggtgcatggagggctcatggcccagctccct

SEQ ID NO: 7200 - DNA, 55 bp, Artificial Sequence
  Synthetic polynucleotide
tgcagctcgggagaggagctggacttgctgaggagctggacttgctcaggggctg

SEQ ID NO: 7201 - DNA, 55 bp, Artificial Sequence
  Synthetic polynucleotide
aggctagctgtgtccgcggcatgcggcatgcggcctggcgcacctgcacgtggag

SEQ ID NO: 7202 - DNA, 55 bp, Artificial Sequence
  Synthetic polynucleotide
ccatggagtaatgctcaatctgatagaagatggtggtcagcccctgggtcgtgaa

SEQ ID NO: 7203 - DNA, 55 bp, Artificial Sequence
  Synthetic polynucleotide
gcccggcccctcaggctccccaaccaggcacggcagtggccactgtgtccatctg

SEQ ID NO: 7204 - DNA, 55 bp, Artificial Sequence
  Synthetic polynucleotide
cagcaaacttcggggggcggcggcggccggcggcaaccagaaaaacagcccggac

SEQ ID NO: 7205 - DNA, 55 bp, Artificial Sequence
  Synthetic polynucleotide
acggccagcgtgtaggggttcagcagggcaggggtgcgtagagcaccagtggccg

SEQ ID NO: 7206 - DNA, 55 bp, Artificial Sequence
  Synthetic polynucleotide
caagcagaaaatgaagaaaagaaaagaaaaaggctgaagcacgagctagaaacaa

SEQ ID NO: 7207 - DNA, 55 bp, Artificial Sequence
  Synthetic polynucleotide
ctgccaccacactccccggctttcggctttcggccccgtttcttgggaatggcct

SEQ ID NO: 7208 - DNA, 55 bp, Artificial Sequence
  Synthetic polynucleotide
tctgcgagagggtggcgggctgggccagccaggtgcagcagtgcgatgtcattgt

SEQ ID NO: 7209 - DNA, 55 bp, Artificial Sequence
  Synthetic polynucleotide
actgagaaacgtcttccagctggggaatgttggaatgttatcttcatggaagcca

SEQ ID NO: 7210 - DNA, 55 bp, Artificial Sequence
  Synthetic polynucleotide
aaatagcagaaataaaagaaaagaaaagattggaactaggtcagctgaagatcct

SEQ ID NO: 7211 - DNA, 55 bp, Artificial Sequence
  Synthetic polynucleotide
aggctgtatctccattgtctcctcgaggtcaggtcgaatatccaaatagcaattt

SEQ ID NO: 7212 - DNA, 55 bp, Artificial Sequence
  Synthetic polynucleotide
gcatcattgccgtggtctcggtcattggcgtggtctcggtcactgtgctgctggc

SEQ ID NO: 7213 - DNA, 55 bp, Artificial Sequence
  Synthetic polynucleotide
gggaaccagcaggaccgggagcaccaggaccgggagcaccagcagggccagcagg

SEQ ID NO: 7214 - DNA, 55 bp, Artificial Sequence
  Synthetic polynucleotide
taggtcttgtcggctgcagcagcagccagctggtgtatctgtagcctttggagca

SEQ ID NO: 7215 - DNA, 55 bp, Artificial Sequence
  Synthetic polynucleotide
ccatggtcgcctccttccacggcacctgcctggttcctggtgggcctggtgagct

SEQ ID NO: 7216 - DNA, 55 bp, Artificial Sequence
  Synthetic polynucleotide
ctgcactggtgtgggcgagtgtcggtcttccggtcttccagtctccagccggtga

SEQ ID NO: 7217 - DNA, 55 bp, Artificial Sequence
  Synthetic polynucleotide
gctgggggccctggacaaggctgggctccctggacaaggctgggctcccggcccc

SEQ ID NO: 7218 - DNA, 55 bp, Artificial Sequence
  Synthetic polynucleotide
ggacggtaacggcggaggcggaggcggaggcggcggaggtaagaaggattccatt

SEQ ID NO: 7219 - DNA, 55 bp, Artificial Sequence
  Synthetic polynucleotide
tggcctttggggtccgggcgtgcgggcgtgcgggcggcgggctcgggcgcgggcg

SEQ ID NO: 7220 - DNA, 55 bp, Artificial Sequence
  Synthetic polynucleotide
tctcaatcaggttgggagcaacaagtgatggggagcaacaagtgatggggcacat

SEQ ID NO: 7221 - DNA, 55 bp, Artificial Sequence
  Synthetic polynucleotide
cccccgcctcctgggcccgggcccgggcccggggctgcaagcgtccttcgggcct

SEQ ID NO: 7222 - DNA, 55 bp, Artificial Sequence
  Synthetic polynucleotide
ccgcccgccggagctgccccggagccgccccggagccgccgctcggaacatggtc

SEQ ID NO: 7223 - DNA, 55 bp, Artificial Sequence
  Synthetic polynucleotide
gagtcgatcctgcgcgcgcgcgccgcgccgtggtcgccttccacacgggcaactt

SEQ ID NO: 7224 - DNA, 55 bp, Artificial Sequence
  Synthetic polynucleotide
ccgggtcggcggccccggggcgacgcgacgtggagagcaggctggatgccctcca

SEQ ID NO: 7225 - DNA, 55 bp, Artificial Sequence
  Synthetic polynucleotide
gaggccacaggcattgcacaggtattgcacaggtagtggccggtgccgtcccgcc

SEQ ID NO: 7226 - DNA, 55 bp, Artificial Sequence
  Synthetic polynucleotide
cggcggctgcagcggcagccgcggcagcagcggcagccgcggcagcagcggcggc

SEQ ID NO: 7227 - DNA, 55 bp, Artificial Sequence
  Synthetic polynucleotide
aggaaatggcgcctgaaaaatggtacagtctggtacagtctgggcaaggttccag

SEQ ID NO: 7228 - DNA, 55 bp, Artificial Sequence
  Synthetic polynucleotide
acatatgtatggcttccaccagggaagacagggaagactttatcatcttctttct

SEQ ID NO: 7229 - DNA, 55 bp, Artificial Sequence
  Synthetic polynucleotide
cacttcgcaaagacgcaggaagaaagacgcaggaagaaatccgcggagagccttt

SEQ ID NO: 7230 - DNA, 55 bp, Artificial Sequence
  Synthetic polynucleotide
agtaagtgtatcttacccacacactttggttggtttctctttactccaaaaacca

SEQ ID NO: 7231 - DNA, 55 bp, Artificial Sequence
  Synthetic polynucleotide
gctgactggacttcccggtgctgtggtctgtggtctgaggggagaacgaggcagt

SEQ ID NO: 7232 - DNA, 55 bp, Artificial Sequence
  Synthetic polynucleotide
ccctctctttttaatgacaaggaaattaattggctttcatgcttccctggcccag

SEQ ID NO: 7233 - DNA, 55 bp, Artificial Sequence
  Synthetic polynucleotide
ataaatgacagaaggcagggacttgacttgaggagcctcttctaccaggcatcac

SEQ ID NO: 7234 - DNA, 55 bp, Artificial Sequence
  Synthetic polynucleotide
agcgcgtccacatgggcgcgcgcgcccacatgggcgcgcgcgcggtcgcgcatct

SEQ ID NO: 7235 - DNA, 55 bp, Artificial Sequence
  Synthetic polynucleotide
cgcccttacccaggcagccgagaaggtcgcaggcagccgagaaggtcgcaggcag

SEQ ID NO: 7236 - DNA, 55 bp, Artificial Sequence
  Synthetic polynucleotide
actttgatcaccatcaccaacaacattgattggctcaatagcaagaatgtgtgcc

SEQ ID NO: 7237 - DNA, 55 bp, Artificial Sequence
  Synthetic polynucleotide
tcaaagcggactttgtggcggaactgggggcggaactgggggcggcacaggggct

SEQ ID NO: 7238 - DNA, 55 bp, Artificial Sequence
  Synthetic polynucleotide
ctagcatgaagacggtgaagacggttaagacggttttctcggtggggcgggacac

SEQ ID NO: 7239 - DNA, 55 bp, Artificial Sequence
  Synthetic polynucleotide
agtataaagagtatcttggactggacatcttggacatcttttaaccaggagagaa

SEQ ID NO: 7240 - DNA, 55 bp, Artificial Sequence
  Synthetic polynucleotide
gctgctgctgctgttgctgctgctgctgctgggcaggctgcaactgtgctgaaag

SEQ ID NO: 7241 - DNA, 55 bp, Artificial Sequence
  Synthetic polynucleotide
gtcttcatagaccattttgtgtttgtttgaaggtatatccagagaagaagacaga

SEQ ID NO: 7242 - DNA, 55 bp, Artificial Sequence
  Synthetic polynucleotide
gccattctccttgaagtactgggggatggatggtggagaagtttccagcgtgcac

SEQ ID NO: 7243 - DNA, 55 bp, Artificial Sequence
  Synthetic polynucleotide
agctggcgggaccacaggtgagcaccgaccgggcaggaggcctcgtctgagccgt

SEQ ID NO: 7244 - DNA, 55 bp, Artificial Sequence
  Synthetic polynucleotide
gaagtattgctcccccagtggattgggtggtggctccattcactccaatgctgag

SEQ ID NO: 7245 - DNA, 55 bp, Artificial Sequence
  Synthetic polynucleotide
cttcctcctggtggttgggatggggctggatggggctggctggggccttcctggc

SEQ ID NO: 7246 - DNA, 55 bp, Artificial Sequence
  Synthetic polynucleotide
cctcttaaaacgctcatagagtaaactaactggttgtgcagtaaaagcaactggt

SEQ ID NO: 7247 - DNA, 55 bp, Artificial Sequence
  Synthetic polynucleotide
gggtcctgtgccgggagacggggctggagacggggctgctggccctgcactcggc

SEQ ID NO: 7248 - DNA, 55 bp, Artificial Sequence
  Synthetic polynucleotide
cagaaaacctaccagggcagctacggtttccggtttccgtctgggcttcttgcat

SEQ ID NO: 7249 - DNA, 55 bp, Artificial Sequence
  Synthetic polynucleotide
caagaaaagtttgcaccataagacttgacttggacttgggttttggaaccttcct

SEQ ID NO: 7250 - DNA, 55 bp, Artificial Sequence
  Synthetic polynucleotide
ttggcctgactacaccgaggacgtggggtggggtttgacatcggccaggcgatgc

SEQ ID NO: 7251 - DNA, 55 bp, Artificial Sequence
  Synthetic polynucleotide
ggggaactgtattttgtggattctattttgtggattctgacccattgcaggatca

SEQ ID NO: 7252 - DNA, 55 bp, Artificial Sequence
  Synthetic polynucleotide
cttctgtttttctccaggtctggtgtggcgtggccctcgaccttgcctgctccac

SEQ ID NO: 7253 - DNA, 55 bp, Artificial Sequence
  Synthetic polynucleotide
ggaaatgtgattgttgcagatacatctatctggtccagctatcctttgcttagga

SEQ ID NO: 7254 - DNA, 55 bp, Artificial Sequence
  Synthetic polynucleotide
ctcccctccctccctgcccccaggagtgagtggttcaccgtcttggagcattacc

SEQ ID NO: 7255 - DNA, 55 bp, Artificial Sequence
  Synthetic polynucleotide
ccctttcttcatcagtggggcgctggagtggggcgctggagtccaagggattgtg

SEQ ID NO: 7256 - DNA, 55 bp, Artificial Sequence
  Synthetic polynucleotide
ccaccagacggaggagctcaacctgtgggtgggtgcgtggctgcagggctgccct

SEQ ID NO: 7257 - DNA, 55 bp, Artificial Sequence
  Synthetic polynucleotide
cagctcctcgccctggagcgcaagttcccctggagcgcaagttccgtcagaaaca

SEQ ID NO: 7258 - DNA, 55 bp, Artificial Sequence
  Synthetic polynucleotide
gcttggctccctgcagtttggctacaacactggctacaacactggagtcatcaat

SEQ ID NO: 7259 - DNA, 55 bp, Artificial Sequence
  Synthetic polynucleotide
attcagatgagcagttgaactctggaactctggaaggcaaagtccttcacagaat

SEQ ID NO: 7260 - DNA, 55 bp, Artificial Sequence
  Synthetic polynucleotide
tcggccgcaggaggcttcagcaccagcaggaggcttcagcaccagcgattacgac

SEQ ID NO: 7261 - DNA, 55 bp, Artificial Sequence
  Synthetic polynucleotide
gccggtggtgcaggatgccgactggccagctggccagctgcaacccagatgccct

SEQ ID NO: 7262 - DNA, 55 bp, Artificial Sequence
  Synthetic polynucleotide
tcctttgtagagagtgttcatctgggaatctgggacttggatgagacaatcattg

SEQ ID NO: 7263 - DNA, 55 bp, Artificial Sequence
  Synthetic polynucleotide
ccattctcctccgtgtacgcaaagtcaaacgggtacacaaagtcaaacgggtaca

SEQ ID NO: 7264 - DNA, 55 bp, Artificial Sequence
  Synthetic polynucleotide
tgaggaggaggaggaggaggaggaggagggcggtggagggggcgagcgcaaggtg

SEQ ID NO: 7265 - DNA, 55 bp, Artificial Sequence
  Synthetic polynucleotide
cctggctgccggtgcagctgtcggtggggtgggggtgtggcagccatagaccggg

SEQ ID NO: 7266 - DNA, 55 bp, Artificial Sequence
  Synthetic polynucleotide
ccttcctgggcatggccgtgagcacccgcatggccgtgagcaccctgtgtggcga

SEQ ID NO: 7267 - DNA, 55 bp, Artificial Sequence
  Synthetic polynucleotide
gcctgcaggctgagcgagcgcaggcagcgcaggcggcgcaggccctgcagcgagc

SEQ ID NO: 7268 - DNA, 55 bp, Artificial Sequence
  Synthetic polynucleotide
ctgagtaatacctctgagcctggaatctcttggaatctcttttgacgagtcatca

SEQ ID NO: 7269 - DNA, 55 bp, Artificial Sequence
  Synthetic polynucleotide
ggtggccccgactgcaaggacaaatctgaaaggacaaatctgacgaggaaaactg

SEQ ID NO: 7270 - DNA, 55 bp, Artificial Sequence
  Synthetic polynucleotide
tgaggctgttcaaggggatggtactctctctggccaatgaagtcattcttggagg

SEQ ID NO: 7271 - DNA, 55 bp, Artificial Sequence
  Synthetic polynucleotide
gtggggctgaggctgcagctggccagcagctggccagcagcagggcaacagccag

SEQ ID NO: 7272 - DNA, 55 bp, Artificial Sequence
  Synthetic polynucleotide
gcgctgccgcgcagatcgcgcagatcgcgcaggcactgctgggcgccgaggagcg

SEQ ID NO: 7273 - DNA, 55 bp, Artificial Sequence
  Synthetic polynucleotide
gattggttattccttcatgatggttcatgatggtattttacactcttccttgcat

SEQ ID NO: 7274 - DNA, 55 bp, Artificial Sequence
  Synthetic polynucleotide
gtttccagtagcagctgacagagggttagagggttattcaacagcccgcccaagc

SEQ ID NO: 7275 - DNA, 55 bp, Artificial Sequence
  Synthetic polynucleotide
tttcacgttgagctgtgcagagaaggcagaaggcaagaaccttctgaagcatttt

SEQ ID NO: 7276 - DNA, 55 bp, Artificial Sequence
  Synthetic polynucleotide
cgccgcccccgaggtccgctgctgcccccgaggtccgctgctgtgtggatgccgt

SEQ ID NO: 7277 - DNA, 55 bp, Artificial Sequence
  Synthetic polynucleotide
ccccttccaccaccatggcaaacaggttcttggcaaacaggttcttcccaatcag

SEQ ID NO: 7278 - DNA, 55 bp, Artificial Sequence
  Synthetic polynucleotide
gagccatttgactacgtggactgtggactgtggcctgggcaggctgtgggcattt

SEQ ID NO: 7279 - DNA, 55 bp, Artificial Sequence
  Synthetic polynucleotide
aggaacgcgttggcgcgccggcgccggcgccggtgcaggacgccgtgggcttcct

SEQ ID NO: 7280 - DNA, 55 bp, Artificial Sequence
  Synthetic polynucleotide
tcatcctgcagctgctgcagctgctgcagctggagccggatgaggaccaggtgcg

SEQ ID NO: 7281 - DNA, 55 bp, Artificial Sequence
  Synthetic polynucleotide
gacagaggtgttggcagtggtggcatgtggtggcatgaggaatagtgacaggcac

SEQ ID NO: 7282 - DNA, 55 bp, Artificial Sequence
  Synthetic polynucleotide
cgatgtggtggggctgaggtcagtagtagtaggtttccttctccacccaacctgg

SEQ ID NO: 7283 - DNA, 55 bp, Artificial Sequence
  Synthetic polynucleotide
gtctgcctccacagggggactccgggactccggcagccccttggtctgcaacggg

SEQ ID NO: 7284 - DNA, 55 bp, Artificial Sequence
  Synthetic polynucleotide
ctcacaccccacagggtggagggtggaacgtggaacgtgcggctgcgtggacctc

SEQ ID NO: 7285 - DNA, 55 bp, Artificial Sequence
  Synthetic polynucleotide
aggtgtgtgactcttcttggatgatgactcaggatgatgactcatcacgttctac

SEQ ID NO: 7286 - DNA, 55 bp, Artificial Sequence
  Synthetic polynucleotide
gaaggcaatctccacgtaaatgaagcgacggggaagcgacgggtgggatctgcca

SEQ ID NO: 7287 - DNA, 55 bp, Artificial Sequence
  Synthetic polynucleotide
gcggcggcggcggcgcgggcggcggcggcgcgggcggcggcggcggcagcagcag

SEQ ID NO: 7288 - DNA, 55 bp, Artificial Sequence
  Synthetic polynucleotide
cgtggggatggggaggcggcggaggggcggcggagggggcggcggtccggccaga

SEQ ID NO: 7289 - DNA, 55 bp, Artificial Sequence
  Synthetic polynucleotide
ccacacagcagcggacctcgggggcggcagcggacctcgggggcggcggcgccca

SEQ ID NO: 7290 - DNA, 55 bp, Artificial Sequence
  Synthetic polynucleotide
gccggcggctttggcggcgtgtgctgtgcctggtgttcgtcggtcaccctctgga

SEQ ID NO: 7291 - DNA, 55 bp, Artificial Sequence
  Synthetic polynucleotide
gccgcttctacccaacggttaccgttaccgtggtcatcgctgacgacagcgacaa

SEQ ID NO: 7292 - DNA, 55 bp, Artificial Sequence
  Synthetic polynucleotide
ggcgcggcggccgccagagcgcgcggggcgcggggcgcggggcgcgggcatggcg

SEQ ID NO: 7293 - DNA, 55 bp, Artificial Sequence
  Synthetic polynucleotide
tcaccgataggcatgaagggctgggaggcaagggctgggaggcagggctgggcct

SEQ ID NO: 7294 - DNA, 55 bp, Artificial Sequence
  Synthetic polynucleotide
aaatagaatttgaaaacttgtctcgtctccaggaagtgttattatattcaggtat

SEQ ID NO: 7295 - DNA, 55 bp, Artificial Sequence
  Synthetic polynucleotide
ggtagagattcatgtcaaggagatagatagtgggggaccccatgttactgaagtg

SEQ ID NO: 7296 - DNA, 55 bp, Artificial Sequence
  Synthetic polynucleotide
ccccgtgatgggtgccattgacatgggcatgggcatgggctcaggggtggacagc

SEQ ID NO: 7297 - DNA, 55 bp, Artificial Sequence
  Synthetic polynucleotide
cctggaagaactgctccacagggttcattcaggtcaggaagcaggtcgtccttcg

SEQ ID NO: 7298 - DNA, 55 bp, Artificial Sequence
  Synthetic polynucleotide
gcagtgctggaagctggaactctgggactctgggagctctggacctggaagtact

SEQ ID NO: 7299 - DNA, 55 bp, Artificial Sequence
  Synthetic polynucleotide
acttcctcttcttctcatgtctccggtctccggtaggccacgtgcatggccacta

SEQ ID NO: 7300 - DNA, 55 bp, Artificial Sequence
  Synthetic polynucleotide
tcagcttcaggttgaatttccagcttcaggtggaatttccagctccaggtgtaac

SEQ ID NO: 7301 - DNA, 55 bp, Artificial Sequence
  Synthetic polynucleotide
aacgggagcttcaagttcttaggtattcttaggtacatcatgtattcatatgact

SEQ ID NO: 7302 - DNA, 55 bp, Artificial Sequence
  Synthetic polynucleotide
cgggctgcccggcgaggtgttcgggcgctcaggtgttcgggcgctcggagcaata

SEQ ID NO: 7303 - DNA, 55 bp, Artificial Sequence
  Synthetic polynucleotide
agaggcggcctctgaagaacagaacagaacaggtaggtgtcaagtgggactagtt

SEQ ID NO: 7304 - DNA, 55 bp, Artificial Sequence
  Synthetic polynucleotide
tcttcctttgcctgggggtcttcctttgcctgggggtcttccttctatggaagaa

SEQ ID NO: 7305 - DNA, 55 bp, Artificial Sequence
  Synthetic polynucleotide
acctgcagccagctctgcgtgaaccgaacctggagggtggctacaagtgccagtg

SEQ ID NO: 7306 - DNA, 55 bp, Artificial Sequence
  Synthetic polynucleotide
caaagtaagacctccggatggttttggttttggtggaggaagtgataattaatat

SEQ ID NO: 7307 - DNA, 55 bp, Artificial Sequence
  Synthetic polynucleotide
ccaatccagctacctcagagcagttctggctggcaacaccatcattccatccaac

SEQ ID NO: 7308 - DNA, 55 bp, Artificial Sequence
  Synthetic polynucleotide
ctccaagtcccagggtgccgtggggctggctggctggcgtcctgctggttgcact

SEQ ID NO: 7309 - DNA, 55 bp, Artificial Sequence
  Synthetic polynucleotide
tggggcgagtgctgctgctgctcgctgtagtggctgctcgctgtagtggctgggg

SEQ ID NO: 7310 - DNA, 55 bp, Artificial Sequence
  Synthetic polynucleotide
cagccagcagcagcagcaggagggtcaagcagggtcagcctggaggccatctggg

SEQ ID NO: 7311 - DNA, 55 bp, Artificial Sequence
  Synthetic polynucleotide
gtcctgtcttttaaaactgtcttttaaaactggcatcatttccctgtgtaaagca

SEQ ID NO: 7312 - DNA, 55 bp, Artificial Sequence
  Synthetic polynucleotide
ccacgtgcgccacggcgttggtcagcgcgttggtcagcgcgtcggccaccttctt

SEQ ID NO: 7313 - DNA, 55 bp, Artificial Sequence
  Synthetic polynucleotide
ttattggttgaattcccagcaacaggcaacaggtggtgtgattccatcttggcaa

SEQ ID NO: 7314 - DNA, 55 bp, Artificial Sequence
  Synthetic polynucleotide
agtgctttcactagacaatataaataaatctggctgtagatcaagacggttaact

SEQ ID NO: 7315 - DNA, 55 bp, Artificial Sequence
  Synthetic polynucleotide
cgcttgacgtagggcacatctgggtgcatctgggtgatacttgggtggcttgaac

SEQ ID NO: 7316 - DNA, 55 bp, Artificial Sequence
  Synthetic polynucleotide
cattaagccaaagaataggcacaatagaataggcacaatatagttcctcttcaga

SEQ ID NO: 7317 - DNA, 55 bp, Artificial Sequence
  Synthetic polynucleotide
caggctgggtggcccggaggctgggcggcccggaggctgggctgggcgagtatct

SEQ ID NO: 7318 - DNA, 55 bp, Artificial Sequence
  Synthetic polynucleotide
tgaggatactgtcaccatcagcctcaatcaaggtcaccctgacgaatctcatctc

SEQ ID NO: 7319 - DNA, 55 bp, Artificial Sequence
  Synthetic polynucleotide
aggagcaatgttcctttagttgggattagttgggactgggggccttcctttccta

SEQ ID NO: 7320 - DNA, 55 bp, Artificial Sequence
  Synthetic polynucleotide
agaagagtaggttggggttgggtttgggtttgggcttccgctcggcctgctcaaa

SEQ ID NO: 7321 - DNA, 55 bp, Artificial Sequence
  Synthetic polynucleotide
cgacgcccgccttgggggcgaggcggggcgaggcggcccggggggcctcgggcgg

SEQ ID NO: 7322 - DNA, 55 bp, Artificial Sequence
  Synthetic polynucleotide
cggcgcccagcagtgcctgcgcgatctgcgcggcagcgcgatctgcgcggcagcg

SEQ ID NO: 7323 - DNA, 55 bp, Artificial Sequence
  Synthetic polynucleotide
gcttacccaaagccttgactgttgagcagccgggccttgtttgcagtccacgaag

SEQ ID NO: 7324 - DNA, 55 bp, Artificial Sequence
  Synthetic polynucleotide
gtatgtgaacaggaagaaaagtatgtgaacaggaagaaaagtatgaaattcctga

SEQ ID NO: 7325 - DNA, 55 bp, Artificial Sequence
  Synthetic polynucleotide
gattgtggtcgtctatgtgctgtgctgtgctgggcacccttcttcctggtgcagc

SEQ ID NO: 7326 - DNA, 55 bp, Artificial Sequence
  Synthetic polynucleotide
tgatgcgcattacgtcctcgctgcggcatgcggttgatgacgcccgccagccccg

SEQ ID NO: 7327 - DNA, 55 bp, Artificial Sequence
  Synthetic polynucleotide
gtggttgggatggggctggctggggctggctggggccttcctggcccattatgtg

SEQ ID NO: 7328 - DNA, 55 bp, Artificial Sequence
  Synthetic polynucleotide
gccggtggagaagcagaaggcgctgcatgcaggcctctggctgaagcaggccttc

SEQ ID NO: 7329 - DNA, 55 bp, Artificial Sequence
  Synthetic polynucleotide
ccgcctcacccttgtccgtgcgcctgcctgcggaaggacaacttgcgcttgcgtt

SEQ ID NO: 7330 - DNA, 55 bp, Artificial Sequence
  Synthetic polynucleotide
gcacccagaattagaacatatcatctggtctggacccttttccagcacaccctgc

SEQ ID NO: 7331 - DNA, 55 bp, Artificial Sequence
  Synthetic polynucleotide
gtgatgctctgcaaggtgggcagcagcagcaggaccagctctccaaagcggccac

SEQ ID NO: 7332 - DNA, 55 bp, Artificial Sequence
  Synthetic polynucleotide
cgaattattggattgtcactatatatatataggcaccttcaactcctcttttggc

SEQ ID NO: 7333 - DNA, 55 bp, Artificial Sequence
  Synthetic polynucleotide
tgaaaatgagcagccatttcgaaaggcaggcggcagaagaggaaattaactctct

SEQ ID NO: 7334 - DNA, 55 bp, Artificial Sequence
  Synthetic polynucleotide
tgccgccgatggcaccaggacgtatgggtatggagccagtctcctggtacctgca

SEQ ID NO: 7335 - DNA, 55 bp, Artificial Sequence
  Synthetic polynucleotide
ctcagaaacaaagaactccttgatgcaggcaggatagggatgctgcatctgctcg

SEQ ID NO: 7336 - DNA, 55 bp, Artificial Sequence
  Synthetic polynucleotide
ctgtgttcgccgggacgcattcggggcgggcgggcggcggcggcggcagcggcgg

SEQ ID NO: 7337 - DNA, 55 bp, Artificial Sequence
  Synthetic polynucleotide
gcccaggcctgcagggcttcccgcacattgcggcattgcggttgcgacagtggta

SEQ ID NO: 7338 - DNA, 55 bp, Artificial Sequence
  Synthetic polynucleotide
gattcaggggatgaggccagtggcagagggaggtgaggggacgggtggctcagcc

SEQ ID NO: 7339 - DNA, 55 bp, Artificial Sequence
  Synthetic polynucleotide
ccggccgccagcgcgtccaggtgcggcgtgcggcgtgcggatgcgggagccgtgg

SEQ ID NO: 7340 - DNA, 55 bp, Artificial Sequence
  Synthetic polynucleotide
gacggcccgggagtcgtcggtgcggtggtgcggtcgggcggcgcgggcggcgcgg

SEQ ID NO: 7341 - DNA, 55 bp, Artificial Sequence
  Synthetic polynucleotide
ctccacagtggtcggaggagacgtagaggtcggaggagacgtagagtttgtctgc

SEQ ID NO: 7342 - DNA, 55 bp, Artificial Sequence
  Synthetic polynucleotide
catggcctccagggcaggcatgcactgcactggctgtccaccatcatccccacgc

SEQ ID NO: 7343 - DNA, 55 bp, Artificial Sequence
  Synthetic polynucleotide
ttccttccagacatttttaaggtaattaattggctttaaaaagagaacatatttt

SEQ ID NO: 7344 - DNA, 55 bp, Artificial Sequence
  Synthetic polynucleotide
ttggcctgggaggcagcatacgcgacgcgacggggtcgttgctgacccaagccgt

SEQ ID NO: 7345 - DNA, 55 bp, Artificial Sequence
  Synthetic polynucleotide
gaacttacgcttggtatgttatcgttggcttggtatgttatcgttggtacagacc

SEQ ID NO: 7346 - DNA, 55 bp, Artificial Sequence
  Synthetic polynucleotide
ggaagaatacaggaggcagtggaagaatacaggaggcaggtaagatgttagatgc

SEQ ID NO: 7347 - DNA, 55 bp, Artificial Sequence
  Synthetic polynucleotide
gacgtgagccggcctcggctggtgctgcctcggctggtgctgccgcggctggcgc

SEQ ID NO: 7348 - DNA, 55 bp, Artificial Sequence
  Synthetic polynucleotide
ggagccgctgctgcaattgaggcaaaattgaggcagcggccctccaagtacacgt

SEQ ID NO: 7349 - DNA, 55 bp, Artificial Sequence
  Synthetic polynucleotide
ggacggctgtcctgcgaacatacctagctagggtgatgccattgggccactgaat

SEQ ID NO: 7350 - DNA, 55 bp, Artificial Sequence
  Synthetic polynucleotide
ctgttctcggtgacgtggcgtggcgtggcgtggaaggcagcgatgaggctgcctg

SEQ ID NO: 7351 - DNA, 55 bp, Artificial Sequence
  Synthetic polynucleotide
agccattgtgaggactctcccagccaacgtcggactctcccagccaacgtcgtaa

SEQ ID NO: 7352 - DNA, 55 bp, Artificial Sequence
  Synthetic polynucleotide
agccaggtaatactggctctgaggtgtgtgtggaacacacaacataatgacgtat

SEQ ID NO: 7353 - DNA, 55 bp, Artificial Sequence
  Synthetic polynucleotide
cagtggccttggccacaggctctgggccacaggctctgggcctctgggaggctcc

SEQ ID NO: 7354 - DNA, 55 bp, Artificial Sequence
  Synthetic polynucleotide
taggcaatcagttcacggggattaccaaccagggaggtacggatcctcttccaag

SEQ ID NO: 7355 - DNA, 55 bp, Artificial Sequence
  Synthetic polynucleotide
agggaacaccagctggctgggaacaccagctggctgatgagcctggagaacccgc

SEQ ID NO: 7356 - DNA, 55 bp, Artificial Sequence
  Synthetic polynucleotide
ggggcaggcggcggtgcggcggccgcgcggcggccgcgtgcagatggtgtgcgtg

SEQ ID NO: 7357 - DNA, 55 bp, Artificial Sequence
  Synthetic polynucleotide
acctcaggccttgggcgtcttgtgtcgcccaggccacatcagtgactccatccct

SEQ ID NO: 7358 - DNA, 55 bp, Artificial Sequence
  Synthetic polynucleotide
gcctgtctgaggcgccctccgactgctggctggagccataccctgtgggcttgtc

SEQ ID NO: 7359 - DNA, 55 bp, Artificial Sequence
  Synthetic polynucleotide
cttcctaagtagatccaggcctgtggcatgtggcagccaaggccaagcaggccca

SEQ ID NO: 7360 - DNA, 55 bp, Artificial Sequence
  Synthetic polynucleotide
cggcggcggcggcggcggcggcggcggcggcggcggcagcggccgccacggccac

SEQ ID NO: 7361 - DNA, 55 bp, Artificial Sequence
  Synthetic polynucleotide
agccaaaaacatcctggatgttgcacggcacggcagcttaacgatgcccattaac

SEQ ID NO: 7362 - DNA, 55 bp, Artificial Sequence
  Synthetic polynucleotide
ccaccatgttcttcaggctggctggcaggcaggtaatgggagtataggtagtgat

SEQ ID NO: 7363 - DNA, 55 bp, Artificial Sequence
  Synthetic polynucleotide
agccttcggctgactggctggccacggccacggccgcggcccggggtcgggtaga

SEQ ID NO: 7364 - DNA, 55 bp, Artificial Sequence
  Synthetic polynucleotide
agcacaacccatggctgcgctgggctgcgctgggctgcgcgaggctgaggtgggc

SEQ ID NO: 7365 - DNA, 55 bp, Artificial Sequence
  Synthetic polynucleotide
cgctcctcctggtgcaggaattgggctatggggctatgtcttcaactgacgttcc

SEQ ID NO: 7366 - DNA, 55 bp, Artificial Sequence
  Synthetic polynucleotide
ggtccgcaggagatgagaaggggaggagaaggggaggagaattcgtggagctgcc

SEQ ID NO: 7367 - DNA, 55 bp, Artificial Sequence
  Synthetic polynucleotide
agcagggtgcgggccacagagatggcgggcgggccacagagatggcggaggctgc

SEQ ID NO: 7368 - DNA, 55 bp, Artificial Sequence
  Synthetic polynucleotide
tttagtttacctcatgagtatgaaactgactggtctttcaccacttccacatcat

SEQ ID NO: 7369 - DNA, 55 bp, Artificial Sequence
  Synthetic polynucleotide
acgcaagcgcaagttgtccttccgcaggccaggcgcacggacaagggtgaggcgg

SEQ ID NO: 7370 - DNA, 55 bp, Artificial Sequence
  Synthetic polynucleotide
ctgctgcagggaggcccggatgctgaagggaggcccggatgctgatggacaccgt

SEQ ID NO: 7371 - DNA, 55 bp, Artificial Sequence
  Synthetic polynucleotide
aactttccatgactggatcacagggatcacagggaaaaaccgaccgagctcagga

SEQ ID NO: 7372 - DNA, 55 bp, Artificial Sequence
  Synthetic polynucleotide
gtccttctcctggccggggccgggggccgggggcgcggcaggcgacgaggcccgg

SEQ ID NO: 7373 - DNA, 55 bp, Artificial Sequence
  Synthetic polynucleotide
acctccccaacgcagctgtaaaactggggggggaagaactttccaaaaccctgga

SEQ ID NO: 7374 - DNA, 55 bp, Artificial Sequence
  Synthetic polynucleotide
ggcttgggatcaataaaagctgaggtgctgaggtgatggcagatactgctgtagc

SEQ ID NO: 7375 - DNA, 55 bp, Artificial Sequence
  Synthetic polynucleotide
cggaatcaaaagggtcgaggtaagggaaaagggtcgaggtaagggaaaagcttct

SEQ ID NO: 7376 - DNA, 55 bp, Artificial Sequence
  Synthetic polynucleotide
ggcaatggcagcaagctgggcggggggggggggtgcagccaggatgacagcagat

SEQ ID NO: 7377 - DNA, 55 bp, Artificial Sequence
  Synthetic polynucleotide
aacatcctcaaggaaaaggggatcgtggtggggatcgtggtgggaatcaaggtga

SEQ ID NO: 7378 - DNA, 55 bp, Artificial Sequence
  Synthetic polynucleotide
ggtatcacactccccatggtgatgcaagcaaggtctccctgaaactgacaggtgg

SEQ ID NO: 7379 - DNA, 55 bp, Artificial Sequence
  Synthetic polynucleotide
ggaaggcgaccacggcgcgcgcgcgcgcgcaggatcgactcgtgtttgttgatgg

SEQ ID NO: 7380 - DNA, 55 bp, Artificial Sequence
  Synthetic polynucleotide
agaaatctctactgaagaggaaaaggataaaggatactggagatctaaaagatag

SEQ ID NO: 7381 - DNA, 55 bp, Artificial Sequence
  Synthetic polynucleotide
cagcggcggcggggaccgcgggggcggcggcggcggcagagtagccctaaccgct

SEQ ID NO: 7382 - DNA, 55 bp, Artificial Sequence
  Synthetic polynucleotide
cggccaggtgaactgtgtggtgatgcgacgaggccttaacgaggatgaactcctg

SEQ ID NO: 7383 - DNA, 55 bp, Artificial Sequence
  Synthetic polynucleotide
cggcggcagcggcagcggcggcagctgcagcggcggcagctggaggcctggctgc

SEQ ID NO: 7384 - DNA, 55 bp, Artificial Sequence
  Synthetic polynucleotide
acgctggttatggcctgcacagactggttatggcctgcacagaagccttcttccc

SEQ ID NO: 7385 - DNA, 55 bp, Artificial Sequence
  Synthetic polynucleotide
tcggtactgctggctacgcaggcaggcaggcggccctgcagaggaggctcaggta

SEQ ID NO: 7386 - DNA, 55 bp, Artificial Sequence
  Synthetic polynucleotide
ggcagtataatccaaagatggtcaaggtcaaggtcgcaaggtatgtatgacattt

SEQ ID NO: 7387 - DNA, 55 bp, Artificial Sequence
  Synthetic polynucleotide
tctaccgggggactttaggcagaggctggctggctataaatggagcttgactcga

SEQ ID NO: 7388 - DNA, 55 bp, Artificial Sequence
  Synthetic polynucleotide
gaggtcctggctgacgacgttccgacgttccggagattgaagaggtgagaggact

SEQ ID NO: 7389 - DNA, 55 bp, Artificial Sequence
  Synthetic polynucleotide
gggactggtctggccgacagttggatggataggtggctgcaaggtatccttcaga

SEQ ID NO: 7390 - DNA, 55 bp, Artificial Sequence
  Synthetic polynucleotide
gggcatagagggcggcgatgatagacaggtcggcgatgatagacaggtcggccac

SEQ ID NO: 7391 - DNA, 55 bp, Artificial Sequence
  Synthetic polynucleotide
gaaaactgcggtatgggcggggccagggcggggccagggtgggggcggggcgtcc

SEQ ID NO: 7392 - DNA, 55 bp, Artificial Sequence
  Synthetic polynucleotide
agtcccggctacagaatggctcctctcctcgggatggtcgatcacaactggggag

SEQ ID NO: 7393 - DNA, 55 bp, Artificial Sequence
  Synthetic polynucleotide
ctggcgggggaacacgctgaagcgcacgcacggccgtgctcctggccctcgcggc

SEQ ID NO: 7394 - DNA, 55 bp, Artificial Sequence
  Synthetic polynucleotide
gctggtgggcccaatgcaggcctcacacacaggccattggctacctcctgggcat

SEQ ID NO: 7395 - DNA, 55 bp, Artificial Sequence
  Synthetic polynucleotide
gaaatggtccaacagaaaaaagagggaaagagggccccattccaccagatgcaca

SEQ ID NO: 7396 - DNA, 55 bp, Artificial Sequence
  Synthetic polynucleotide
aagcacaccacgttctttggggccatcatcaggctgggtgaagcccctgcatcct

SEQ ID NO: 7397 - DNA, 55 bp, Artificial Sequence
  Synthetic polynucleotide
gctcaatgtcatttcttgccaaggcctgcctggcaccatcccagggccggcccgg

SEQ ID NO: 7398 - DNA, 55 bp, Artificial Sequence
  Synthetic polynucleotide
tctcgggccccgccccgctccgccccgccccggagggatcctcaggccgggccca

SEQ ID NO: 7399 - DNA, 55 bp, Artificial Sequence
  Synthetic polynucleotide
atgccgctctgctcctgaacgtggaaggaaggggtcaagaaaaccattctgcacg

SEQ ID NO: 7400 - DNA, 55 bp, Artificial Sequence
  Synthetic polynucleotide
ggtcttgagacccggtcttgggacggacgcagggctaccgtgcagctgagggtgc

SEQ ID NO: 7401 - DNA, 55 bp, Artificial Sequence
  Synthetic polynucleotide
gtcctccgccccttacccaggaggaggcagaggcagcggcagcagccaggcggct

SEQ ID NO: 7402 - DNA, 55 bp, Artificial Sequence
  Synthetic polynucleotide
cccgggtcggcggccccggggcgacggccccggggcgacgtggagagcaggctgg

SEQ ID NO: 7403 - DNA, 55 bp, Artificial Sequence
  Synthetic polynucleotide
cagtggagttgatgagagccgtacgcaggcaggctgttcccgcagccccaggtgt

SEQ ID NO: 7404 - DNA, 55 bp, Artificial Sequence
  Synthetic polynucleotide
ccacagcccccagcaggggaggcccccagcaggggaggcccacacctgccccagc

SEQ ID NO: 7405 - DNA, 55 bp, Artificial Sequence
  Synthetic polynucleotide
ccagggggtaaagaggcgctaccaggcaggcgggcgggccacggcgcttctgtac

SEQ ID NO: 7406 - DNA, 55 bp, Artificial Sequence
  Synthetic polynucleotide
ttgatgatcttgactctccgtccaaggaggaggaggtgtttcgctttgtacagag

SEQ ID NO: 7407 - DNA, 55 bp, Artificial Sequence
  Synthetic polynucleotide
cacgcgactcgaggctgtgcgggaaatgtgcgggaaatgtcggagacccatcact

SEQ ID NO: 7408 - DNA, 55 bp, Artificial Sequence
  Synthetic polynucleotide
aggcccagcgatctcatcgtttgcgccgcctggacggcgatggagcacatcagcc

SEQ ID NO: 7409 - DNA, 55 bp, Artificial Sequence
  Synthetic polynucleotide
atccaagttctgcacagagtagaagagaagtggtcagcctcaaaaggctgccact

SEQ ID NO: 7410 - DNA, 55 bp, Artificial Sequence
  Synthetic polynucleotide
tggtggccccgactgcaaggacagactgcaaggacaaatctgacgaggaaaactg

SEQ ID NO: 7411 - DNA, 55 bp, Artificial Sequence
  Synthetic polynucleotide
tcaggagcgccctgttctgaaggcaggtgaaggcaggtgcagcatggctggcttc

SEQ ID NO: 7412 - DNA, 55 bp, Artificial Sequence
  Synthetic polynucleotide
tgcgcaagccggtgctcacggccatggccatggggctgctggcgctgctgggtga

SEQ ID NO: 7413 - DNA, 55 bp, Artificial Sequence
  Synthetic polynucleotide
cctcccgtcctcccccagaaaaaggtgcaaaggtgcactgcctcaacatggacag

SEQ ID NO: 7414 - DNA, 55 bp, Artificial Sequence
  Synthetic polynucleotide
agatgaccagcgggatgaagaaggcgaagaaggcgaagaagtcgatggtgaggtt

SEQ ID NO: 7415 - DNA, 55 bp, Artificial Sequence
  Synthetic polynucleotide
tcttcacaggggacagactctggatgactctggatgttctggggagagaggagag

SEQ ID NO: 7416 - DNA, 55 bp, Artificial Sequence
  Synthetic polynucleotide
tactaagggatatttgttcttacaggcaacaggcaacaatgcaggatttggaaca

SEQ ID NO: 7417 - DNA, 55 bp, Artificial Sequence
  Synthetic polynucleotide
gggtggtctttcttgtgctgcatacggagccggagccgctcagcctcctcgatga

SEQ ID NO: 7418 - DNA, 55 bp, Artificial Sequence
  Synthetic polynucleotide
aacgacacctatcatggtgacacttacttatggcccaaaccagcttcctccttgg

SEQ ID NO: 7419 - DNA, 55 bp, Artificial Sequence
  Synthetic polynucleotide
ggggcctcccagccgcagggcggggggggctggcggcgcgcagaccctccgagca

SEQ ID NO: 7420 - DNA, 55 bp, Artificial Sequence
  Synthetic polynucleotide
ctcttggttgcagggatggattatatatattggaatgcaaatctgcaattaaaag

SEQ ID NO: 7421 - DNA, 55 bp, Artificial Sequence
  Synthetic polynucleotide
gcagggccgtcgcgaggctgggccgtcgcgaggctgtgaagctgcttcgccggtg

SEQ ID NO: 7422 - DNA, 55 bp, Artificial Sequence
  Synthetic polynucleotide
tcccacaccaggcaggccagaagcagcagctggccagaagcagcagctggacagc

SEQ ID NO: 7423 - DNA, 55 bp, Artificial Sequence
  Synthetic polynucleotide
gtttcaagttccttttttaaggcctttttaaggcctcttgtgctacaggtggagc

SEQ ID NO: 7424 - DNA, 55 bp, Artificial Sequence
  Synthetic polynucleotide
gcctctcggcgctgctgctgctgctgctgcaggtaccccggatcccctgacttgc

SEQ ID NO: 7425 - DNA, 55 bp, Artificial Sequence
  Synthetic polynucleotide
atgcttggtactcatgataaggatgatataaggatgatatgtcgcgaactttgct

SEQ ID NO: 7426 - DNA, 55 bp, Artificial Sequence
  Synthetic polynucleotide
gcaaggacaaatctgacgacaaatctgacgaggaaaactgcggtatgggcggggc

SEQ ID NO: 7427 - DNA, 55 bp, Artificial Sequence
  Synthetic polynucleotide
tctgcagaccccaagctggcactggtgagctggtgagggacgtctgtatcctgct

SEQ ID NO: 7428 - DNA, 55 bp, Artificial Sequence
  Synthetic polynucleotide
aagcttgactttgtccttgtggatgggggggggctgtgtcctaagccatggccac

SEQ ID NO: 7429 - DNA, 55 bp, Artificial Sequence
  Synthetic polynucleotide
tttttttctgctcccaggcagcggtagtagcggtagtagtggtgttcaattttgc

SEQ ID NO: 7430 - DNA, 55 bp, Artificial Sequence
  Synthetic polynucleotide
agttttcctctgtggacctgaagccttccttggctgaaaccctgagtaaacaaag

SEQ ID NO: 7431 - DNA, 55 bp, Artificial Sequence
  Synthetic polynucleotide
caagagctgggagctggggtccaggattccaggatagtgtactcaaagctggcag

SEQ ID NO: 7432 - DNA, 55 bp, Artificial Sequence
  Synthetic polynucleotide
tttgaagattatgtgatagaaaagctgggctggagcaatgcgggttctttgacga

SEQ ID NO: 7433 - DNA, 55 bp, Artificial Sequence
  Synthetic polynucleotide
atatgcactctgaaggcatccttgctctgaaggcatccttgctggtgaattgaaa

SEQ ID NO: 7434 - DNA, 55 bp, Artificial Sequence
  Synthetic polynucleotide
agcggggcttccgggtgggcggcccgcccgtggcactcctgtaccgctgctgctt

SEQ ID NO: 7435 - DNA, 55 bp, Artificial Sequence
  Synthetic polynucleotide
gaagtccaggatggctgtggagtcctgcctgggtcagcagccaggacaggagggc

SEQ ID NO: 7436 - DNA, 55 bp, Artificial Sequence
  Synthetic polynucleotide
ccgccgtcttcgtgctggcgctcttcgtgctggcgctcttcgtgccgcgcgttaa

SEQ ID NO: 7437 - DNA, 55 bp, Artificial Sequence
  Synthetic polynucleotide
tcggctgtggctgggtgtggctcccctggctgggtgtggctccccgggcagccag

SEQ ID NO: 7438 - DNA, 55 bp, Artificial Sequence
  Synthetic polynucleotide
ccaacatgatcccgggctcccccggcagtacggcagtacggagttagagggtggc

SEQ ID NO: 7439 - DNA, 55 bp, Artificial Sequence
  Synthetic polynucleotide
actctctgtcaactgaaaagagtgccagccaggatatcttcctcttctctaaaca

SEQ ID NO: 7440 - DNA, 55 bp, Artificial Sequence
  Synthetic polynucleotide
cgtgggagcttacggggccaaccaggtaggtggctgtgtacaggtgagcactggc

SEQ ID NO: 7441 - DNA, 55 bp, Artificial Sequence
  Synthetic polynucleotide
gctgactcacttctcctccgaggcggcctgcggcctggcgctccatgcggagcgc

SEQ ID NO: 7442 - DNA, 55 bp, Artificial Sequence
  Synthetic polynucleotide
gcccttccggggtcgccccctgggctctcctgggctcagggttcagcagctccgg

SEQ ID NO: 7443 - DNA, 55 bp, Artificial Sequence
  Synthetic polynucleotide
gcgacagtgacccctggagaccagcatcatcggccggcatcacagcagcactgca

SEQ ID NO: 7444 - DNA, 55 bp, Artificial Sequence
  Synthetic polynucleotide
tacaaaccagcagagttccacacggcatcacggcatttctcaaaatcagagtcct

SEQ ID NO: 7445 - DNA, 55 bp, Artificial Sequence
  Synthetic polynucleotide
cacgtggactctgcgaaacatctcagcacaaggcagcacccttgtgtgcatccat

SEQ ID NO: 7446 - DNA, 55 bp, Artificial Sequence
  Synthetic polynucleotide
gccgcgtcaactgctcgggccgcgggccgcgggctgcggacgctcggtcccgcgc

SEQ ID NO: 7447 - DNA, 55 bp, Artificial Sequence
  Synthetic polynucleotide
tgtaggtgaagttggagacagggacaccgttggagacagggacaccgttggagag

SEQ ID NO: 7448 - DNA, 55 bp, Artificial Sequence
  Synthetic polynucleotide
gagccccaggagccatagctggggcagggcaggggcaggggcccggagcatctgt

SEQ ID NO: 7449 - DNA, 55 bp, Artificial Sequence
  Synthetic polynucleotide
ccctcctgaggcttctgtgctcctggctcctggcttcttacgccgtccaggccaa

SEQ ID NO: 7450 - DNA, 55 bp, Artificial Sequence
  Synthetic polynucleotide
gggccggcacacacctggaaaggtcaggtcaggtccacgaaggccttgaactcct

SEQ ID NO: 7451 - DNA, 55 bp, Artificial Sequence
  Synthetic polynucleotide
cagcagctcggtggagtggagcactcacttcgggcgagcgctcggccagtgcccg

SEQ ID NO: 7452 - DNA, 55 bp, Artificial Sequence
  Synthetic polynucleotide
ggggctccaagcccaaggtggccaagcccaaggtggccacccccaaggtggtgga

SEQ ID NO: 7453 - DNA, 55 bp, Artificial Sequence
  Synthetic polynucleotide
cccggaccaaccgcggggccccggggccccggggccaggcgcgcagcagcaggcg

SEQ ID NO: 7454 - DNA, 55 bp, Artificial Sequence
  Synthetic polynucleotide
cgagcacttcaatgccatgggcaagtacgtgggcaagtacgtggacaagcggctg

SEQ ID NO: 7455 - DNA, 55 bp, Artificial Sequence
  Synthetic polynucleotide
tcacagcctccccgatgctgttggcgtagagggcatgctgttggcgtagagggca

SEQ ID NO: 7456 - DNA, 55 bp, Artificial Sequence
  Synthetic polynucleotide
accactgtctccttggtcagcggaggcgggcggcttgggcttgggtggggccgtg

SEQ ID NO: 7457 - DNA, 55 bp, Artificial Sequence
  Synthetic polynucleotide
gagggtgaacaggaggactcactggttcactggtgagggagacgccccggggcct

SEQ ID NO: 7458 - DNA, 55 bp, Artificial Sequence
  Synthetic polynucleotide
aaatacattttattgatggacatttattgatggacattatagctgctgatgactg

SEQ ID NO: 7459 - DNA, 55 bp, Artificial Sequence
  Synthetic polynucleotide
tttaagtatccattgggacaaagtatccattgggacatgaagttaaccacagtcg

SEQ ID NO: 7460 - DNA, 55 bp, Artificial Sequence
  Synthetic polynucleotide
ccgggtcatggaggcctcgtatgttatgtgaggcaaaacttgcccatgtcctggg

SEQ ID NO: 7461 - DNA, 55 bp, Artificial Sequence
  Synthetic polynucleotide
gaggcgcgtctgtctgcggccgccgtgccgtggccgggtcggccagggcgcccga

SEQ ID NO: 7462 - DNA, 55 bp, Artificial Sequence
  Synthetic polynucleotide
tgcgggtgggcgctgcgcacgtccggtccgtggcgggatcaccactcgcaggccg

SEQ ID NO: 7463 - DNA, 55 bp, Artificial Sequence
  Synthetic polynucleotide
tcagtctactcacatgagcataactaactcaggaagaagagctggttgttggtga

SEQ ID NO: 7464 - DNA, 55 bp, Artificial Sequence
  Synthetic polynucleotide
aagagatctcattatttcaattggttggtaaggatttcagaaaggggatagtgga

SEQ ID NO: 7465 - DNA, 55 bp, Artificial Sequence
  Synthetic polynucleotide
cagctggtgtgggaacgtcagttaggagttaggacttcccctctacctgtgggct

SEQ ID NO: 7466 - DNA, 55 bp, Artificial Sequence
  Synthetic polynucleotide
aacaaaggtgtttcaattcaatacaatacctggaaaaaaatacactattagcatg

SEQ ID NO: 7467 - DNA, 55 bp, Artificial Sequence
  Synthetic polynucleotide
agccccaccagcagccacagtgtgctgctctggaacggctgcatgaacgagtcca

SEQ ID NO: 7468 - DNA, 55 bp, Artificial Sequence
  Synthetic polynucleotide
tgtgatgattgtgagcataacactacatacaggtaagtagcaaataaattcctga

SEQ ID NO: 7469 - DNA, 55 bp, Artificial Sequence
  Synthetic polynucleotide
gtgcggcggaggcgggggtgcggccggggcgggggtgcggccggcgggcctccca

SEQ ID NO: 7470 - DNA, 55 bp, Artificial Sequence
  Synthetic polynucleotide
ccatggcgggtcaggaggagacgtctcaggaggagacgtctcaggatgagaccta

SEQ ID NO: 7471 - DNA, 55 bp, Artificial Sequence
  Synthetic polynucleotide
ttttgtgcatctggtggaatggggccctggtggaatggggccctcttttttctgt

SEQ ID NO: 7472 - DNA, 55 bp, Artificial Sequence
  Synthetic polynucleotide
gttgatggagaccgtgcatttctgcatttctggccgccggctggagggagagcca

SEQ ID NO: 7473 - DNA, 55 bp, Artificial Sequence
  Synthetic polynucleotide
ctgttcacaccgaagctcaaggtggagacaaggtggagacggacatggaatcttc

SEQ ID NO: 7474 - DNA, 55 bp, Artificial Sequence
  Synthetic polynucleotide
ggaagactcctcggcataagtggaccgacctggcgggcagcctgggcagagcggg

SEQ ID NO: 7475 - DNA, 55 bp, Artificial Sequence
  Synthetic polynucleotide
acatccccctctccagcccgggtcggcgggcggccccggggcgacgtggagagca

SEQ ID NO: 7476 - DNA, 55 bp, Artificial Sequence
  Synthetic polynucleotide
caggaccgggcgcggagcctcgcaggggcagggtcgggctcgggctccctaaccg

SEQ ID NO: 7477 - DNA, 55 bp, Artificial Sequence
  Synthetic polynucleotide
attgggtgagagagaagtctcgagaccaccgggataggcaccgagaggtaagaca

SEQ ID NO: 7478 - DNA, 55 bp, Artificial Sequence
  Synthetic polynucleotide
agcactcgcggcctgggcgcggaggagcggaggagcgcaggagcccggttcgcga

SEQ ID NO: 7479 - DNA, 55 bp, Artificial Sequence
  Synthetic polynucleotide
cccgagagtgggcaccaagcggtacgtacatggcacccgaggtgctggacgagca

SEQ ID NO: 7480 - DNA, 55 bp, Artificial Sequence
  Synthetic polynucleotide
cggctctgctcatccccgtcgtgctcgctgaggtcgtgctcgctgaggtcgtgct

SEQ ID NO: 7481 - DNA, 55 bp, Artificial Sequence
  Synthetic polynucleotide
ctgaactcctcgggctcggactacggactacggcaccatgtcctgctccaccttg

SEQ ID NO: 7482 - DNA, 55 bp, Artificial Sequence
  Synthetic polynucleotide
ggagcagccaggggaggtgtcggccggccttggggccgggccgggcgggggcagg

SEQ ID NO: 7483 - DNA, 55 bp, Artificial Sequence
  Synthetic polynucleotide
acgcagaggtgtggaatgaggccgaggccgaggccaaggcggacctccagaaagt

SEQ ID NO: 7484 - DNA, 55 bp, Artificial Sequence
  Synthetic polynucleotide
ggcggcgcgggcggcggcggcggcagcaggcggcagcagcagcggcggcgggagt

SEQ ID NO: 7485 - DNA, 55 bp, Artificial Sequence
  Synthetic polynucleotide
gctgtgatcgccgcatcagcaggggcctgcaggggcaggaccacgtccacctccg

SEQ ID NO: 7486 - DNA, 55 bp, Artificial Sequence
  Synthetic polynucleotide
atctgtgatggcatctacaactggggcaactggggtgaggtcggacatggccagg

SEQ ID NO: 7487 - DNA, 55 bp, Artificial Sequence
  Synthetic polynucleotide
gttcgtggtgccaatcagtggatcaagttttggatcaagtttaagtcagtcagtt

SEQ ID NO: 7488 - DNA, 55 bp, Artificial Sequence
  Synthetic polynucleotide
cgtcttcattggccacttgtgccttgtgcctggccgacctggccgtggctctgtt

SEQ ID NO: 7489 - DNA, 55 bp, Artificial Sequence
  Synthetic polynucleotide
acgctgaggcagcggcggcaggtggaggagtggaggaggagatcctggcgctgaa

SEQ ID NO: 7490 - DNA, 55 bp, Artificial Sequence
  Synthetic polynucleotide
aggcagcgccagccgcggcagcaccagccgcggcagcaccagccgaggccggctc

SEQ ID NO: 7491 - DNA, 55 bp, Artificial Sequence
  Synthetic polynucleotide
ccccgccgcggcgaggagcaaggcgacggacggtccagcgcaatttccagcccca

SEQ ID NO: 7492 - DNA, 55 bp, Artificial Sequence
  Synthetic polynucleotide
aggactcggcaggacacagggtagagagcccggacacagggtagagagcccagtc

SEQ ID NO: 7493 - DNA, 55 bp, Artificial Sequence
  Synthetic polynucleotide
ccgcgagactacgaaggcctgtgggtgctgtgggtgctgagggtgccgtccacca

SEQ ID NO: 7494 - DNA, 55 bp, Artificial Sequence
  Synthetic polynucleotide
ccgggccacgcaccgcctgctgctgctgctgggtaagggcgggcggggggcgccg

SEQ ID NO: 7495 - DNA, 55 bp, Artificial Sequence
  Synthetic polynucleotide
cggcttgggccggggcggtttggggcggtttggggcgcagatagccgtgcagcgc

SEQ ID NO: 7496 - DNA, 55 bp, Artificial Sequence
  Synthetic polynucleotide
cctgctcggacagctccaggtacgtctgtctggtggtcaatcaggcccttgcggt

SEQ ID NO: 7497 - DNA, 55 bp, Artificial Sequence
  Synthetic polynucleotide
tcggaatgtaacttttgaggacgctgacgctggggaatatacgtgcttggcgggt

SEQ ID NO: 7498 - DNA, 55 bp, Artificial Sequence
  Synthetic polynucleotide
ccacccttacgtagatcggctgctgcagatcggctgctgcgccaggagctggagg

SEQ ID NO: 7499 - DNA, 55 bp, Artificial Sequence
  Synthetic polynucleotide
ccccggcccggcccgcagctctgggctggctggcagcgccagaagtgccaagcag

SEQ ID NO: 7500 - DNA, 55 bp, Artificial Sequence
  Synthetic polynucleotide
accagctgccccagctactggcccagctactggtggaacggagacaaatatctgg

SEQ ID NO: 7501 - DNA, 55 bp, Artificial Sequence
  Synthetic polynucleotide
ggcgggtcgggggcggggctgggctgggctgggctggaaggtgagctcgggaacg

SEQ ID NO: 7502 - DNA, 55 bp, Artificial Sequence
  Synthetic polynucleotide
gccagcttgacattgagcaggtcctgcaagtggtactcctgcaagtggcgggcca

SEQ ID NO: 7503 - DNA, 55 bp, Artificial Sequence
  Synthetic polynucleotide
ggcgcctgctgccactgcccgggaggcatgcggcatgctgggcatgacgggcccg

SEQ ID NO: 7504 - DNA, 55 bp, Artificial Sequence
  Synthetic polynucleotide
gaggccgccaggcgggtcgggggcgggcgggggcggggctgggctggaaggtgag

SEQ ID NO: 7505 - DNA, 55 bp, Artificial Sequence
  Synthetic polynucleotide
cgcggcagctgcggggagagatgactgactggggagcgacccagcacggcgctcc

SEQ ID NO: 7506 - DNA, 55 bp, Artificial Sequence
  Synthetic polynucleotide
cggaagggaaaagggaactcctctcctctatggtcagcttcttctgtactttttc

SEQ ID NO: 7507 - DNA, 55 bp, Artificial Sequence
  Synthetic polynucleotide
ggtctccacgggtggctcctggggccgggccggggctcctctgcccggggctgca

SEQ ID NO: 7508 - DNA, 55 bp, Artificial Sequence
  Synthetic polynucleotide
caaggtgatcagttggtccttctcggtcctcggtcctttgattgtttaataagat

SEQ ID NO: 7509 - DNA, 55 bp, Artificial Sequence
  Synthetic polynucleotide
tgcaggctgagcgagcgcaggcggcgcaggcggcgcaggccctgcagcgagctgg

SEQ ID NO: 7510 - DNA, 55 bp, Artificial Sequence
  Synthetic polynucleotide
aggcgcagggcgggggccgcggcgcgggggcgggggccgcggcgcgggggcgggg

SEQ ID NO: 7511 - DNA, 55 bp, Artificial Sequence
  Synthetic polynucleotide
ccaatggctaagtgaagatgacaatcatgttggacaatcatgttgcagcaattca

SEQ ID NO: 7512 - DNA, 55 bp, Artificial Sequence
  Synthetic polynucleotide
gtggtcctggagaagtggcactgcctgcccaggaactgggaggccggcacgtcca

SEQ ID NO: 7513 - DNA, 55 bp, Artificial Sequence
  Synthetic polynucleotide
tccatgttgctgacccggtagtagggtagtaggtctgctgggagaagtagaggcg

SEQ ID NO: 7514 - DNA, 55 bp, Artificial Sequence
  Synthetic polynucleotide
tccacgtgaacttgagcactgtgagcactgtggggattctccgtgctctggactc

SEQ ID NO: 7515 - DNA, 55 bp, Artificial Sequence
  Synthetic polynucleotide
tttttctcaaatgtttagggtgactgactgtggtaataaccactgacatcacagt

SEQ ID NO: 7516 - DNA, 55 bp, Artificial Sequence
  Synthetic polynucleotide
ttaggtcttgtcggctgcagcagcagcagctggtgtatctgtagcctttggagca

SEQ ID NO: 7517 - DNA, 55 bp, Artificial Sequence
  Synthetic polynucleotide
gcacaggggcgcgcggcgcacgggtccgcgcggcgcacgggtccgcgcgctcgcg

SEQ ID NO: 7518 - DNA, 55 bp, Artificial Sequence
  Synthetic polynucleotide
gtaggtgaagctgagcagcagcagcagcaggggcagctggtactggatggccacg

SEQ ID NO: 7519 - DNA, 55 bp, Artificial Sequence
  Synthetic polynucleotide
tcctgttgtttcagatacagccaggctgataggctgatgccctgaagtatgtcgg

SEQ ID NO: 7520 - DNA, 55 bp, Artificial Sequence
  Synthetic polynucleotide
ttcgatccagggcaaggaggtggggttgtggggttcagtgaggacagggctgagc

SEQ ID NO: 7521 - DNA, 55 bp, Artificial Sequence
  Synthetic polynucleotide
ccttaccagccatatcagtctgtgggactgtgggatctggtacagttttgtaaat

SEQ ID NO: 7522 - DNA, 55 bp, Artificial Sequence
  Synthetic polynucleotide
tgttggtcctgctggtgctgttggccctgctggtgctgttggcccaagaggtcct

SEQ ID NO: 7523 - DNA, 55 bp, Artificial Sequence
  Synthetic polynucleotide
agaatacagtgggcagagacaggtaggtactgggccacgatggggctgcaaggaa

SEQ ID NO: 7524 - DNA, 55 bp, Artificial Sequence
  Synthetic polynucleotide
acccctccactgttacaagcagctgggcctgggcctgggcctgcctagaggtctg

SEQ ID NO: 7525 - DNA, 55 bp, Artificial Sequence
  Synthetic polynucleotide
cgactgcaaggacaaatctgacatctgacgaggaaaactgcggtatgggcggggc

SEQ ID NO: 7526 - DNA, 55 bp, Artificial Sequence
  Synthetic polynucleotide
acgtggctgaagaaagcaagagtggtggtgaggcttggagaagtaccctacaagg

SEQ ID NO: 7527 - DNA, 55 bp, Artificial Sequence
  Synthetic polynucleotide
gcgcacggctggccgtaggcggcgggcggcgggcggcgcggcggcgtagggcagc

SEQ ID NO: 7528 - DNA, 55 bp, Artificial Sequence
  Synthetic polynucleotide
agagaagtcatccagggctggggcagggctggggcagggctgggggcggggcagg

SEQ ID NO: 7529 - DNA, 55 bp, Artificial Sequence
  Synthetic polynucleotide
tggtgaagtcgtgctgaagatgaaagaaagtggaagggatgacctgccattcatg

SEQ ID NO: 7530 - DNA, 55 bp, Artificial Sequence
  Synthetic polynucleotide
gggcccgggggcccgggaggcgaaccccccgggaggcgaacccggcaagggcggc

SEQ ID NO: 7531 - DNA, 55 bp, Artificial Sequence
  Synthetic polynucleotide
tgccctgggccgggctgcccggctcgtccccggctcgtcgccgcctccgacgccc

SEQ ID NO: 7532 - DNA, 55 bp, Artificial Sequence
  Synthetic polynucleotide
cggccgcggctgcggcggcggccgcggctgcggcggcggccgcggccaaccagtg

SEQ ID NO: 7533 - DNA, 55 bp, Artificial Sequence
  Synthetic polynucleotide
gccccgactgcaaggacaaatctgactgcaaggacaaatctgacgaggaaaactg

SEQ ID NO: 7534 - DNA, 55 bp, Artificial Sequence
  Synthetic polynucleotide
gcggccgcaaccggggcactgcagctaccggggcactgcagctgccgccgccgca

SEQ ID NO: 7535 - DNA, 55 bp, Artificial Sequence
  Synthetic polynucleotide
tgagccaagcactcacgtccatgtagtagttggtgaggatcacggaggaggtggt

SEQ ID NO: 7536 - DNA, 55 bp, Artificial Sequence
  Synthetic polynucleotide
tatactggcggatgtgctctggcgagtagatggcgagtagatggagagcagctgg

SEQ ID NO: 7537 - DNA, 55 bp, Artificial Sequence
  Synthetic polynucleotide
gttttaatgatgccaaggagaaaggtgaggtggtgacaaaggtgagccactagct

SEQ ID NO: 7538 - DNA, 55 bp, Artificial Sequence
  Synthetic polynucleotide
aatggccaaccctattattgggaatgggaatggtggagctcctgatactactgct

SEQ ID NO: 7539 - DNA, 55 bp, Artificial Sequence
  Synthetic polynucleotide
cacggagggcagggaggcgcgcacgctcggaggcgcgcacgctcacaggcacctg

SEQ ID NO: 7540 - DNA, 55 bp, Artificial Sequence
  Synthetic polynucleotide
cactttctgataggcagcctgcactggtggtggggtgaattctttgccaaagtga

SEQ ID NO: 7541 - DNA, 55 bp, Artificial Sequence
  Synthetic polynucleotide
ttgttctcgggcagcttctggtctgtctgtaggaattgcacctcacctagaagag

SEQ ID NO: 7542 - DNA, 55 bp, Artificial Sequence
  Synthetic polynucleotide
ggagccaggagcacggcagcgggccctcagcgggccctcagcgcagtcagcgtcc

SEQ ID NO: 7543 - DNA, 55 bp, Artificial Sequence
  Synthetic polynucleotide
cttggacgaaaatgcttggacgaaaatgcttggtgagctggggatctcctgcccc

SEQ ID NO: 7544 - DNA, 55 bp, Artificial Sequence
  Synthetic polynucleotide
agcgcatccagtcgccgatgaagagaagaacgggagcatgttgatggcagactcg

SEQ ID NO: 7545 - DNA, 55 bp, Artificial Sequence
  Synthetic polynucleotide
catccagcctgctctccacgtcgcccgccccggggccgccgacccgggctggaga

SEQ ID NO: 7546 - DNA, 55 bp, Artificial Sequence
  Synthetic polynucleotide
aactgagccagctgcagacggagctgcagacggagctcctggcggccctgctcga

SEQ ID NO: 7547 - DNA, 55 bp, Artificial Sequence
  Synthetic polynucleotide
agctgcgagagagccaaaaaggccatgcatgggctaccagccactagtgaccatg

SEQ ID NO: 7548 - DNA, 55 bp, Artificial Sequence
  Synthetic polynucleotide
gcatttctgccgggccgtgtgccgccccgccgggccgagagacggtaagagggct

SEQ ID NO: 7549 - DNA, 55 bp, Artificial Sequence
  Synthetic polynucleotide
cggggccccaggggcccccacactacgctggggcccccacactacaccgaccagc

SEQ ID NO: 7550 - DNA, 55 bp, Artificial Sequence
  Synthetic polynucleotide
tctgccatagcagctggcagctgctgctgctggcagctgctgctgctggaagaag

SEQ ID NO: 7551 - DNA, 55 bp, Artificial Sequence
  Synthetic polynucleotide
ggtggccccgactgcaaggacaaatctgacaggacaaatctgacgaggaaaactg

SEQ ID NO: 7552 - DNA, 55 bp, Artificial Sequence
  Synthetic polynucleotide
tccggcctttagtctcaggaactttgaatcaggaactttgaagtaggtgaagatg

SEQ ID NO: 7553 - DNA, 55 bp, Artificial Sequence
  Synthetic polynucleotide
cagtggtagtcaggccagtgacaatgagtcaggccagtgacaatgagggacattc

SEQ ID NO: 7554 - DNA, 55 bp, Artificial Sequence
  Synthetic polynucleotide
ggaggtcaatgggttccttctgaatgatgatggtcctggtgcctgggaagtgggc

SEQ ID NO: 7555 - DNA, 55 bp, Artificial Sequence
  Synthetic polynucleotide
cgggtttcaggattcactttcttcctgcctgggaacgaaccctctatttaccagg

SEQ ID NO: 7556 - DNA, 55 bp, Artificial Sequence
  Synthetic polynucleotide
ctgcagcagcgccgcgggagcgagggagcgagggagccagggctgcgggtgtggc

SEQ ID NO: 7557 - DNA, 55 bp, Artificial Sequence
  Synthetic polynucleotide
gaagccatcaatgagctcactgttctgttctggtgctggttaacaccatttactt

SEQ ID NO: 7558 - DNA, 55 bp, Artificial Sequence
  Synthetic polynucleotide
ggttttctcctcaggggtctctcttttttttggcatgtcggccctgttactccct

SEQ ID NO: 7559 - DNA, 55 bp, Artificial Sequence
  Synthetic polynucleotide
tggagtagaggtgggccacagaggccgcagaggccgcaaaggccaccacgtcctc

SEQ ID NO: 7560 - DNA, 55 bp, Artificial Sequence
  Synthetic polynucleotide
cagttccaccttcaccgtcaccgtccgtccggggcctgcggggagacagacgcgg

SEQ ID NO: 7561 - DNA, 55 bp, Artificial Sequence
  Synthetic polynucleotide
ccccatgaatatgaacatgggtatgaacatgggtatgaacatggcagcagccgcg

SEQ ID NO: 7562 - DNA, 55 bp, Artificial Sequence
  Synthetic polynucleotide
ggtctactttggtcaaaacgaatatgaatatggttctccttccatgagggtccat

SEQ ID NO: 7563 - DNA, 55 bp, Artificial Sequence
  Synthetic polynucleotide
ggcgcgtggccgtggaggaggtggatgaggtggatgaggagggcaagtttgtccg

SEQ ID NO: 7564 - DNA, 55 bp, Artificial Sequence
  Synthetic polynucleotide
tgttggtcctgctggtgctgttggtcctgctggtgctgttggcccaagaggtcct

SEQ ID NO: 7565 - DNA, 55 bp, Artificial Sequence
  Synthetic polynucleotide
aaataaataaaccaacctggagcgtgagtgaggtaatcagccaggatctggatag

SEQ ID NO: 7566 - DNA, 55 bp, Artificial Sequence
  Synthetic polynucleotide
gtgatgttgggagtgcaggactaaagggtagggtgacaaggtgagtgtgggcatg

SEQ ID NO: 7567 - DNA, 55 bp, Artificial Sequence
  Synthetic polynucleotide
gatctcccggagcggaggggacaggcaggcaggccaggtggaaggcccgagggca

SEQ ID NO: 7568 - DNA, 55 bp, Artificial Sequence
  Synthetic polynucleotide
tcaatgaacttacgcttggtatgttatccttggtatgttatcgttggtacagacc

SEQ ID NO: 7569 - DNA, 55 bp, Artificial Sequence
  Synthetic polynucleotide
gggcttcatgcagctgcctgactcggtcctcggtcctcgacggccacctgggagg

SEQ ID NO: 7570 - DNA, 55 bp, Artificial Sequence
  Synthetic polynucleotide
aggccagctcattgttgtcaatgacggaggaggcagcagccacgtccaggggcgt

SEQ ID NO: 7571 - DNA, 55 bp, Artificial Sequence
  Synthetic polynucleotide
catagtgagccgagaggccgaggcggccggaggccgaggagccgtggggcgagga

SEQ ID NO: 7572 - DNA, 55 bp, Artificial Sequence
  Synthetic polynucleotide
gggtgcctgcatgggggaacgccggagaattggagaattaccatccccccgcacc

SEQ ID NO: 7573 - DNA, 55 bp, Artificial Sequence
  Synthetic polynucleotide
ccgcagcttcccgggccgcggcagcggcagcggcggcggcggccgccagggaccc

SEQ ID NO: 7574 - DNA, 55 bp, Artificial Sequence
  Synthetic polynucleotide
ggcactggtccaccacatccacagacagacaggttctggttggtcagagccgctt

SEQ ID NO: 7575 - DNA, 55 bp, Artificial Sequence
  Synthetic polynucleotide
ccctcaccttggaggatgaggcgatggcgatggagtagtagcgggcctgcaggcg

SEQ ID NO: 7576 - DNA, 55 bp, Artificial Sequence
  Synthetic polynucleotide
tagctgaggggcagtgtcagcgaggaagcgaggaagcgagatcgtggctggactg

SEQ ID NO: 7577 - DNA, 55 bp, Artificial Sequence
  Synthetic polynucleotide
taccaggctgagctgcgagagctgcggctgcggctgcggctcgatcaactcaccg

SEQ ID NO: 7578 - DNA, 55 bp, Artificial Sequence
  Synthetic polynucleotide
aagagaattctcttaccaacatctggtcaatggtcaataaattccttcaagacca

SEQ ID NO: 7579 - DNA, 55 bp, Artificial Sequence
  Synthetic polynucleotide
cagaccagcacgttgcccaggagctagctgtgggaggaagataagaggtatgaac

SEQ ID NO: 7580 - DNA, 55 bp, Artificial Sequence
  Synthetic polynucleotide
cgcctcgcgcagcgctcgtggcagcggcggcggcagctgcagcagcagcagcagc

SEQ ID NO: 7581 - DNA, 55 bp, Artificial Sequence
  Synthetic polynucleotide
atacctgtaattcaccaaaggatgactgacaggagcccagcaccatatgccttta

SEQ ID NO: 7582 - DNA, 55 bp, Artificial Sequence
  Synthetic polynucleotide
cgcaagagcatcaacaaatcactagaggagaggagacattttgtattttaggcat

SEQ ID NO: 7583 - DNA, 55 bp, Artificial Sequence
  Synthetic polynucleotide
ccagccaacgtcgtaatcgctggtaatcgctggtgctgaagcctcctgcggccga

SEQ ID NO: 7584 - DNA, 55 bp, Artificial Sequence
  Synthetic polynucleotide
agagacctggagggagctcaccagacagacaggtcagggctgatgatgttcaagc

SEQ ID NO: 7585 - DNA, 55 bp, Artificial Sequence
  Synthetic polynucleotide
gtatttcattgttcgctgaaggggaagggaaggctcgcaagcgatgtagattgaa

SEQ ID NO: 7586 - DNA, 55 bp, Artificial Sequence
  Synthetic polynucleotide
cccgtacctcggtagctgtggatgcggcggcggcccgtgccaggcggcagcgttg

SEQ ID NO: 7587 - DNA, 55 bp, Artificial Sequence
  Synthetic polynucleotide
gcccttgccgggttcgcctcccgggcccccgggcccccgggccccgccgcccccg

SEQ ID NO: 7588 - DNA, 55 bp, Artificial Sequence
  Synthetic polynucleotide
tctccagccaggccatgtacagcgagcagctggggcacttccccttcctccctat

SEQ ID NO: 7589 - DNA, 55 bp, Artificial Sequence
  Synthetic polynucleotide
accctctttataaaagcacagtaggacagtaggaggaaggcgaaatgaaaatttg

SEQ ID NO: 7590 - DNA, 55 bp, Artificial Sequence
  Synthetic polynucleotide
cctcggccgcctcggcctctcggctcactatggctcactatgcgcaccttctgcc

SEQ ID NO: 7591 - DNA, 55 bp, Artificial Sequence
  Synthetic polynucleotide
ggcgcgcagggcggcgcgggcctcccgcgcgggcctcccggcgcaggcggcgctc

SEQ ID NO: 7592 - DNA, 55 bp, Artificial Sequence
  Synthetic polynucleotide
gccctgggctcaggtactcacagatggcggcggcggcggccaggcatttcacaac

SEQ ID NO: 7593 - DNA, 55 bp, Artificial Sequence
  Synthetic polynucleotide
acctgcagccgggcgagcagcgcgcagagcaggagcagcgcgcagagcagcagca

SEQ ID NO: 7594 - DNA, 55 bp, Artificial Sequence
  Synthetic polynucleotide
tgctgcccggccgccggcccgcgggcccgcgggccccgggtcccccgcgacgtcc

SEQ ID NO: 7595 - DNA, 55 bp, Artificial Sequence
  Synthetic polynucleotide
agatcgagctggagatctcggaggcatcggaggcagccagccctggcacgcgcat

SEQ ID NO: 7596 - DNA, 55 bp, Artificial Sequence
  Synthetic polynucleotide
tcccgacagagttatggatgccgaagatgatggagccgttgcaccaggtggcagc

SEQ ID NO: 7597 - DNA, 55 bp, Artificial Sequence
  Synthetic polynucleotide
actgcaaggacaaatctgacgagtctgacgaggaaaactgcggtatgggcggggc

SEQ ID NO: 7598 - DNA, 55 bp, Artificial Sequence
  Synthetic polynucleotide
cttcttctgccccaggagtgaactggtgtctggtgtgagaggaccaccctgagca

SEQ ID NO: 7599 - DNA, 55 bp, Artificial Sequence
  Synthetic polynucleotide
aaattcttccagtcatcttcactaatgtaatggatggtcttgtgtgaccaagtgc

SEQ ID NO: 7600 - DNA, 55 bp, Artificial Sequence
  Synthetic polynucleotide
gtggtacctcataggtgttattggaggtggtggttcgggtgcccttcacaccgtg

SEQ ID NO: 7601 - DNA, 55 bp, Artificial Sequence
  Synthetic polynucleotide
ccagaccaggaacccactcacacttcacactggtcatctctggctcgggacactg

SEQ ID NO: 7602 - DNA, 55 bp, Artificial Sequence
  Synthetic polynucleotide
agttattcaaaagggacatagaaaatcaaaagggacatagaaaagcaagagaatt

SEQ ID NO: 7603 - DNA, 55 bp, Artificial Sequence
  Synthetic polynucleotide
cctctcggggccaggtgccattttggggccaggtgccattttgcttggatgcctg

SEQ ID NO: 7604 - DNA, 55 bp, Artificial Sequence
  Synthetic polynucleotide
ggcatcttcaaacttattcagaacttattcagggctttctcctgtctgtactgaa

SEQ ID NO: 7605 - DNA, 55 bp, Artificial Sequence
  Synthetic polynucleotide
aagatggatgtataactttttggcacaggcaggacaagatctacgtggtcactga

SEQ ID NO: 7606 - DNA, 55 bp, Artificial Sequence
  Synthetic polynucleotide
ggggcgggggcggaggccggggggccgcggcggaggccggggggccgcggcggcc

SEQ ID NO: 7607 - DNA, 55 bp, Artificial Sequence
  Synthetic polynucleotide
gcagacgcgtccggctgcgctgcgctgcgctgggaccaggctcggagccctccgc

SEQ ID NO: 7608 - DNA, 55 bp, Artificial Sequence
  Synthetic polynucleotide
agccgctccaggtctttctgcacatttgggtggtcttccgcacatttgggtggtc

SEQ ID NO: 7609 - DNA, 55 bp, Artificial Sequence
  Synthetic polynucleotide
ttggctgccatgaacttctcctccatcatctggatcttcagggcgtccatctccc

SEQ ID NO: 7610 - DNA, 55 bp, Artificial Sequence
  Synthetic polynucleotide
tgggccaaaaatccccgcttgtgaacactggggtcgcttgtgaacactggggtcg

SEQ ID NO: 7611 - DNA, 55 bp, Artificial Sequence
  Synthetic polynucleotide
tgggcgtcagcctgcgcacgctgcgcacgctggcatggaaccgctccttgaagct

SEQ ID NO: 7612 - DNA, 55 bp, Artificial Sequence
  Synthetic polynucleotide
acggctggagtgtgaggagtgtgaggagtgtggcggcctgggctccccaacaggc

SEQ ID NO: 7613 - DNA, 55 bp, Artificial Sequence
  Synthetic polynucleotide
tatacacatagacacaagggcctgaagcaagggcctgaagcaagtgccagagctg

SEQ ID NO: 7614 - DNA, 55 bp, Artificial Sequence
  Synthetic polynucleotide
ttagggttgcccataacagcatcaggagtcaggagtggacagatccccaaaggac

SEQ ID NO: 7615 - DNA, 55 bp, Artificial Sequence
  Synthetic polynucleotide
ctgaaaaactgagacaaaccccaggatgctaggatgctgcagagcagagtgtatg

SEQ ID NO: 7616 - DNA, 55 bp, Artificial Sequence
  Synthetic polynucleotide
gtggggggccgcatctacattgacgacgacgggctcatctccctagtggtccaga

SEQ ID NO: 7617 - DNA, 55 bp, Artificial Sequence
  Synthetic polynucleotide
tctccacagtgacgggtgtctccacagtgacggctgcccgcatcctcaagggtca

SEQ ID NO: 7618 - DNA, 55 bp, Artificial Sequence
  Synthetic polynucleotide
tccatttaccagcatgcataatgaatgggtgggtgcccagtggtcactatctaac

SEQ ID NO: 7619 - DNA, 55 bp, Artificial Sequence
  Synthetic polynucleotide
tcctggtgcgggagactcgggagctggagctggagctggaggaggagttgtacgc

SEQ ID NO: 7620 - DNA, 55 bp, Artificial Sequence
  Synthetic polynucleotide
cggcacgtgcatcgacggcatcggcggcatcggcagcttcagctgcgactgccgc

SEQ ID NO: 7621 - DNA, 55 bp, Artificial Sequence
  Synthetic polynucleotide
actcctcaccctccagcagcttgcggtggtaggtggcgatctccacgtccagggc

SEQ ID NO: 7622 - DNA, 55 bp, Artificial Sequence
  Synthetic polynucleotide
gagcgggccgcccgaagcagggtgtagtgtaggaagtcacagccacgtccaggag

SEQ ID NO: 7623 - DNA, 55 bp, Artificial Sequence
  Synthetic polynucleotide
caacgccctgctaagcaacatgagcttagcaggatctactccaccgccaaggtct

SEQ ID NO: 7624 - DNA, 55 bp, Artificial Sequence
  Synthetic polynucleotide
ggcctcggccgcctcggcctctcggcctctcggctcactatgcgcaccttctgcc

SEQ ID NO: 7625 - DNA, 55 bp, Artificial Sequence
  Synthetic polynucleotide
aacagcagcgacgcatgtctcgcggtaccgcggtaccttgtcaggtcgcaaggct

SEQ ID NO: 7626 - DNA, 55 bp, Artificial Sequence
  Synthetic polynucleotide
gctccggtgtggcctttgctgtggttgggttggggcctgccaggccctgggtctc

SEQ ID NO: 7627 - DNA, 55 bp, Artificial Sequence
  Synthetic polynucleotide
gaggtcctatcccatgacctatactcactcaggcttcaggttatagtcaaggata

SEQ ID NO: 7628 - DNA, 55 bp, Artificial Sequence
  Synthetic polynucleotide
ggctgtgctgcagcttgatgaggtcagatgaggtcaacttgtattcagcaggtac

SEQ ID NO: 7629 - DNA, 55 bp, Artificial Sequence
  Synthetic polynucleotide
cagcagcgtggtgcggccagtggaagaccgcggccagtggaagaccaccgccagg

SEQ ID NO: 7630 - DNA, 55 bp, Artificial Sequence
  Synthetic polynucleotide
gctacctcagagctgagctgcgaggtgtcgaggtgtcggaggagaactgtgagcg

SEQ ID NO: 7631 - DNA, 55 bp, Artificial Sequence
  Synthetic polynucleotide
gcttctcaaggacaggatggtgaacagggatggtgaacagcaatcttgccagtgt

SEQ ID NO: 7632 - DNA, 55 bp, Artificial Sequence
  Synthetic polynucleotide
gaaggagaacaaggagttgatgagggagggaggtgtttccaaagaattttttcag

SEQ ID NO: 7633 - DNA, 55 bp, Artificial Sequence
  Synthetic polynucleotide
agaattaattacagggctcgtccaactaactggtccctcagtcacacatgccaga

SEQ ID NO: 7634 - DNA, 55 bp, Artificial Sequence
  Synthetic polynucleotide
agagagattgttgaaggccatcacgtatgaaggccatcacgtatgccaaaggatt

SEQ ID NO: 7635 - DNA, 55 bp, Artificial Sequence
  Synthetic polynucleotide
ctattatgcttctcaaggttatgcttctcaaggacaggatggtgaacagcaatct

SEQ ID NO: 7636 - DNA, 55 bp, Artificial Sequence
  Synthetic polynucleotide
ttcgggcaggtgctggggatgctgctgctggggatgctgctgctggactctgtgc

SEQ ID NO: 7637 - DNA, 55 bp, Artificial Sequence
  Synthetic polynucleotide
gtttcgacatggcggtgcagccgaaggaggcggtgcagccgaaggagacgctgca

SEQ ID NO: 7638 - DNA, 55 bp, Artificial Sequence
  Synthetic polynucleotide
gcacccccaggaacatcggggctgcggtgcgggaacttgcacagggagctctgca

SEQ ID NO: 7639 - DNA, 55 bp, Artificial Sequence
  Synthetic polynucleotide
gcagctggtggacccagcccggccaggagcaggagatttcaaccaagcagccatg

SEQ ID NO: 7640 - DNA, 55 bp, Artificial Sequence
  Synthetic polynucleotide
ttactgtagtggccgtagtacatgacatgacggtgtgggtgaagcaaccctgcca

SEQ ID NO: 7641 - DNA, 55 bp, Artificial Sequence
  Synthetic polynucleotide
gctggcctgccgggagccggaggtggacggtggtcctgcccctgcaggtgctgat

SEQ ID NO: 7642 - DNA, 55 bp, Artificial Sequence
  Synthetic polynucleotide
aatggattggcaaggacgcctaccatgcatgggctggctgcactgggagcgcttc

SEQ ID NO: 7643 - DNA, 55 bp, Artificial Sequence
  Synthetic polynucleotide
tctgggtcatttacagcaccgatgacccagaggccaaaggtgccattgtcctctc

SEQ ID NO: 7644 - DNA, 55 bp, Artificial Sequence
  Synthetic polynucleotide
tggcacgccagcggaaatgcttgatttcagcggaaatgcttgatttcttcaatga

SEQ ID NO: 7645 - DNA, 55 bp, Artificial Sequence
  Synthetic polynucleotide
cttgctgaattgactaatctggatcctatctggatcctcaaagggaaacacctca

SEQ ID NO: 7646 - DNA, 55 bp, Artificial Sequence
  Synthetic polynucleotide
gcctcttaaaacgctcatagagtaactaactggttgtgcagtaaaagcaactggt

SEQ ID NO: 7647 - DNA, 55 bp, Artificial Sequence
  Synthetic polynucleotide
cttcagcagtgtgccggccagccggcccgccggcccagcgagcagctgctgcagc

SEQ ID NO: 7648 - DNA, 55 bp, Artificial Sequence
  Synthetic polynucleotide
gggcggcgcggcggcgtagggcagcgccagcggcgtagggcagcgccagcggcgg

SEQ ID NO: 7649 - DNA, 55 bp, Artificial Sequence
  Synthetic polynucleotide
tcagcagcctcaccagtgtgggcttcgtgtgggcttcggcaacgtctctcccaac

SEQ ID NO: 7650 - DNA, 55 bp, Artificial Sequence
  Synthetic polynucleotide
ggcactcaccggtggtcctgccggaggcggaggcgtagagggacagcacggcctg

SEQ ID NO: 7651 - DNA, 55 bp, Artificial Sequence
  Synthetic polynucleotide
gctgcaactccatccgggtggagagcggcgcggctgctggatgctctatgagcgt

SEQ ID NO: 7652 - DNA, 55 bp, Artificial Sequence
  Synthetic polynucleotide
aagcaacttcaggatgagatgctgcggcggcgggtggatgctgagaacaggctgc

SEQ ID NO: 7653 - DNA, 55 bp, Artificial Sequence
  Synthetic polynucleotide
caaggcaacctttgatgaggaggaaggatgaggaggaaggtcgggatgaatacga

SEQ ID NO: 7654 - DNA, 55 bp, Artificial Sequence
  Synthetic polynucleotide
caaagggaagagatgcaaatgggtggggggtggggggtgggaccctcccccagcc

SEQ ID NO: 7655 - DNA, 55 bp, Artificial Sequence
  Synthetic polynucleotide
tcatgggagtgcccttgttgaggtgttgttgggacaggtgggactggttgaggcc

SEQ ID NO: 7656 - DNA, 55 bp, Artificial Sequence
  Synthetic polynucleotide
tgcatacctaatcattatgctgaggatttgaggatttggaaagggtgtttattcc

SEQ ID NO: 7657 - DNA, 55 bp, Artificial Sequence
  Synthetic polynucleotide
gccctcaccttgaccaaaagcaggaagagcaggaagagcagcgaggccgccaggc

SEQ ID NO: 7658 - DNA, 55 bp, Artificial Sequence
  Synthetic polynucleotide
ggcgcagcgcaaaggggcggacgctgagggcggacgctgagggcggccagggcgc

SEQ ID NO: 7659 - DNA, 55 bp, Artificial Sequence
  Synthetic polynucleotide
cccggcaggtaggccccttgcaatgtgggtgggctctcacacgtgcaggtcacca

SEQ ID NO: 7660 - DNA, 55 bp, Artificial Sequence
  Synthetic polynucleotide
tacagtactcccaccgcacttggctgttgttggttgtatggcaccatggggccct

SEQ ID NO: 7661 - DNA, 55 bp, Artificial Sequence
  Synthetic polynucleotide
ctcacaccccacagggtggagggtggagggtggaacgtgcggctgcgtggacctc

SEQ ID NO: 7662 - DNA, 55 bp, Artificial Sequence
  Synthetic polynucleotide
gcagaaccatggcattttatagctgcttgctgggtcctcttggcactcacctggc

SEQ ID NO: 7663 - DNA, 55 bp, Artificial Sequence
  Synthetic polynucleotide
cacacaggtaggcggtggcggtgccggtgccggcactgtcagggacctgggcatt

SEQ ID NO: 7664 - DNA, 55 bp, Artificial Sequence
  Synthetic polynucleotide
tctgtgctctcgtggaaactgtccacaacacgggctgccagtgtgcacttggcgg

SEQ ID NO: 7665 - DNA, 55 bp, Artificial Sequence
  Synthetic polynucleotide
aggatatgatatcatggaaccagcagcacatggaaccagcagcaaagaagtgcta

SEQ ID NO: 7666 - DNA, 55 bp, Artificial Sequence
  Synthetic polynucleotide
ccattccactgcatggttcactctgaacggaggttcactctgaacggagctggca

SEQ ID NO: 7667 - DNA, 55 bp, Artificial Sequence
  Synthetic polynucleotide
ccccggcgcggctgctgcgcggcggctgcgcggcggctggacgagtcgctgtctg

SEQ ID NO: 7668 - DNA, 55 bp, Artificial Sequence
  Synthetic polynucleotide
gtggcgatgccgctgtccgaggagcgtccgaggagctctggcggccaacctcctg

SEQ ID NO: 7669 - DNA, 55 bp, Artificial Sequence
  Synthetic polynucleotide
tgagccccgacgagtccgactccggtactccggtgaggcctggcctgagctgggg

SEQ ID NO: 7670 - DNA, 55 bp, Artificial Sequence
  Synthetic polynucleotide
caccacggtggactttggaacagaattttcaggttggtgtttgtagtaacagaaa

SEQ ID NO: 7671 - DNA, 55 bp, Artificial Sequence
  Synthetic polynucleotide
tcctggcagccaacagcatgattgacagacaggaagccgcgcctgctcttcccca

SEQ ID NO: 7672 - DNA, 55 bp, Artificial Sequence
  Synthetic polynucleotide
agcttgctggaggcgggcgaggagcggccgaggagcggccgggggagcaaagcca

SEQ ID NO: 7673 - DNA, 55 bp, Artificial Sequence
  Synthetic polynucleotide
aggcggctcccaagacattcacgtggttcgtggttcactttcacggccagacctt

SEQ ID NO: 7674 - DNA, 55 bp, Artificial Sequence
  Synthetic polynucleotide
cttcaacaactatgacccaggaagccgagccggccagtgcgggagcctgaggata

SEQ ID NO: 7675 - DNA, 55 bp, Artificial Sequence
  Synthetic polynucleotide
ctgaaacccgatgaagatgcccaccacccacggaataattcatctcggaaagaga

SEQ ID NO: 7676 - DNA, 55 bp, Artificial Sequence
  Synthetic polynucleotide
cttctagtccttcttggaatggccttggaatggccttggaagcatccctagcaca

SEQ ID NO: 7677 - DNA, 55 bp, Artificial Sequence
  Synthetic polynucleotide
tcgtagagggagccgtgctcgtggtgctcgtggtagtgcgtgatgagccacagct

SEQ ID NO: 7678 - DNA, 55 bp, Artificial Sequence
  Synthetic polynucleotide
tgtagtgtgctcaaaagacaaggttacttacggagaaggcttccgctggatggca

SEQ ID NO: 7679 - DNA, 55 bp, Artificial Sequence
  Synthetic polynucleotide
gggccccgaaatggtgctgctgccccgaaatggtgctgctgcgcttggagcacca

SEQ ID NO: 7680 - DNA, 55 bp, Artificial Sequence
  Synthetic polynucleotide
ctgtgatcaaagttttgggattaaagttttgggattcatgttgcagagcttgcta

SEQ ID NO: 7681 - DNA, 55 bp, Artificial Sequence
  Synthetic polynucleotide
ttactttttaaaactgttcttagtgttcttaggctggagctattggccagaaact

SEQ ID NO: 7682 - DNA, 55 bp, Artificial Sequence
  Synthetic polynucleotide
ccatcatgtacagttgctggcatgagttttaggtaagtgctttattaggatctct

SEQ ID NO: 7683 - DNA, 55 bp, Artificial Sequence
  Synthetic polynucleotide
aggaggagggtgagggggaagaggagggagggggaagaggaggaaggggaggggg

SEQ ID NO: 7684 - DNA, 55 bp, Artificial Sequence
  Synthetic polynucleotide
ccggggcgtgtcaacgcggcgctcggcgctcggcctacgccttctcgcaccagcg

SEQ ID NO: 7685 - DNA, 55 bp, Artificial Sequence
  Synthetic polynucleotide
ctgaagtattcattatagtcaagggcataagggcatatcctacaacaaacttgtc

SEQ ID NO: 7686 - DNA, 55 bp, Artificial Sequence
  Synthetic polynucleotide
ttgcatattttaaaagtggaaataggaaataggtggtgatgggcagacaacaggt

SEQ ID NO: 7687 - DNA, 55 bp, Artificial Sequence
  Synthetic polynucleotide
ttgggctcaggcccatgcaggctgggtgggaggcagcacgtagtccggtgcggga

SEQ ID NO: 7688 - DNA, 55 bp, Artificial Sequence
  Synthetic polynucleotide
cctgacgacaccgccgggccgggctgggctgggctgagagcgagggtttggcaaa

SEQ ID NO: 7689 - DNA, 55 bp, Artificial Sequence
  Synthetic polynucleotide
ttcctggacaaaaataccaatctattgttgtgggctctgggaatcctgctgccac

SEQ ID NO: 7690 - DNA, 55 bp, Artificial Sequence
  Synthetic polynucleotide
tctcatagtagtgctgctgcgtgctgcgtgcggatccagcgccccacgaggtggt

SEQ ID NO: 7691 - DNA, 55 bp, Artificial Sequence
  Synthetic polynucleotide
aaccaggttgctgagtgttacaacgaaaaaaggcagactgctcatctccccaggc

SEQ ID NO: 7692 - DNA, 55 bp, Artificial Sequence
  Synthetic polynucleotide
cgatggcggcggcggcggcggcggcagcggcggcggcggcagcagcagcgggggc

SEQ ID NO: 7693 - DNA, 55 bp, Artificial Sequence
  Synthetic polynucleotide
cgccccacgcactctgcggcaagtcctctgcggcaagtcctcggcccggaagacc

SEQ ID NO: 7694 - DNA, 55 bp, Artificial Sequence
  Synthetic polynucleotide
ggatcgcggagcaggacgcccgcggcgagcaggacgcccgcggcgcgcagggccg

SEQ ID NO: 7695 - DNA, 55 bp, Artificial Sequence
  Synthetic polynucleotide
caccggggtcggaggcgccgcctgggttggaggcgccgcctgggttggggtctgg

SEQ ID NO: 7696 - DNA, 55 bp, Artificial Sequence
  Synthetic polynucleotide
cctgctggcagcgctttatgcggatctatctggatgatgggccagaagcgggtca

SEQ ID NO: 7697 - DNA, 55 bp, Artificial Sequence
  Synthetic polynucleotide
ttctgtgaactacttacgaactgctgggttgggttgtgtcaaatatataagttca

SEQ ID NO: 7698 - DNA, 55 bp, Artificial Sequence
  Synthetic polynucleotide
tgctgctttactcactgtgcatgatgatgttggaggcttggaactctggatcctc

SEQ ID NO: 7699 - DNA, 55 bp, Artificial Sequence
  Synthetic polynucleotide
cctacagcgtcactgtcgatggctgcacgatggctgcacggtgagtgcccagaat

SEQ ID NO: 7700 - DNA, 55 bp, Artificial Sequence
  Synthetic polynucleotide
agcggcggcggcgggggcggcgggggcggcgggggcaccgggtgcccgcagcagc

SEQ ID NO: 7701 - DNA, 55 bp, Artificial Sequence
  Synthetic polynucleotide
acctccggatggttttggtggaggaagtggaggaagtgataattaatatgaggca

SEQ ID NO: 7702 - DNA, 55 bp, Artificial Sequence
  Synthetic polynucleotide
gatacctgtatttacaaccctttgtttgtttggatcagatcttcagtatacaaat

SEQ ID NO: 7703 - DNA, 55 bp, Artificial Sequence
  Synthetic polynucleotide
gggctccgggcagtgctggcggcgtcctggcggcgtcctggctgccctgctggac

SEQ ID NO: 7704 - DNA, 55 bp, Artificial Sequence
  Synthetic polynucleotide
ctcctcatcagaaatcttgaactccactccaggtcttcagtgtagcgctttctct

SEQ ID NO: 7705 - DNA, 55 bp, Artificial Sequence
  Synthetic polynucleotide
caagtttgtggcccgcaactacctggaacctggtaaaagagtgtgtgcagcctgc

SEQ ID NO: 7706 - DNA, 55 bp, Artificial Sequence
  Synthetic polynucleotide
gcccaacatggagccagatgtgaaggagggaggaaactgagggcaagagaaatga

SEQ ID NO: 7707 - DNA, 55 bp, Artificial Sequence
  Synthetic polynucleotide
acgagatgtttcggatttcattccattccacgggaaggagatcttgggggtcagt

SEQ ID NO: 7708 - DNA, 55 bp, Artificial Sequence
  Synthetic polynucleotide
ctccgaggcggcctggcgctccatgcggagcggagcgcggcctccacgctctggc

SEQ ID NO: 7709 - DNA, 55 bp, Artificial Sequence
  Synthetic polynucleotide
tggcccccacaaggtcagctggtagcgtagcggctgttctgctcgtagaaatcgg

SEQ ID NO: 7710 - DNA, 55 bp, Artificial Sequence
  Synthetic polynucleotide
cccacagcatcaccaccgccggagggtccagggtccagtgctcactttccagagt

SEQ ID NO: 7711 - DNA, 55 bp, Artificial Sequence
  Synthetic polynucleotide
tttttttttttaggcgtttcatcaaacggcgggtatatgtgtctttaccaaatga

SEQ ID NO: 7712 - DNA, 55 bp, Artificial Sequence
  Synthetic polynucleotide
tcgaggccgaggaggaggaggaggaggtggtggaaggggaagaaggcggaatggt

SEQ ID NO: 7713 - DNA, 55 bp, Artificial Sequence
  Synthetic polynucleotide
ccctgcgtcccaagaccgggtctcaagaccgggtctcaagaccaggtgagtgggg

SEQ ID NO: 7714 - DNA, 55 bp, Artificial Sequence
  Synthetic polynucleotide
ttgcagtgtgggcaactgcagcccggacggaggcagtgtggcccaaaactgaacc

SEQ ID NO: 7715 - DNA, 55 bp, Artificial Sequence
  Synthetic polynucleotide
tcaccccacacaggtagacggtggcggtggcggtgccggcactgtcagggacctg

SEQ ID NO: 7716 - DNA, 55 bp, Artificial Sequence
  Synthetic polynucleotide
ggttcactctgaacgatggtggcaatcgaacggagctggcaatcgaacgactctc

SEQ ID NO: 7717 - DNA, 55 bp, Artificial Sequence
  Synthetic polynucleotide
ggctcgatacgtcttctccaacttcatccacggctgtcccgaagaggtccaggcg

SEQ ID NO: 7718 - DNA, 55 bp, Artificial Sequence
  Synthetic polynucleotide
ccctggtgctcctggtgctcctggtgctcctggtccccctggccccgttggccct

SEQ ID NO: 7719 - DNA, 55 bp, Artificial Sequence
  Synthetic polynucleotide
gaccaccccgaggggaacgaggggaacgaggggaacggccctcggccgtacgggg

SEQ ID NO: 7720 - DNA, 55 bp, Artificial Sequence
  Synthetic polynucleotide
cagaattcgggaaatgtcgcacggccggccgggccccgctgtgagctagctctac

SEQ ID NO: 7721 - DNA, 55 bp, Artificial Sequence
  Synthetic polynucleotide
acccaactgggatggaaaggagatagatacgggattccccagggtgagcacaaca

SEQ ID NO: 7722 - DNA, 55 bp, Artificial Sequence
  Synthetic polynucleotide
gcatcttcatcatggacgaggccacggcttcggcttccattgacatggccacggt

SEQ ID NO: 7723 - DNA, 55 bp, Artificial Sequence
  Synthetic polynucleotide
ggaggcagcctcctcacgactggaagctcatggaagctcaaggcgtgagtttaca

SEQ ID NO: 7724 - DNA, 55 bp, Artificial Sequence
  Synthetic polynucleotide
gctgcagcagaaactgttcatctgtctgtccggtaggtggggtgggggtgggggt

SEQ ID NO: 7725 - DNA, 55 bp, Artificial Sequence
  Synthetic polynucleotide
ccgtcgcccccgccgccgccgtggccgccgtggccgccgtgccctcgagccccgc

SEQ ID NO: 7726 - DNA, 55 bp, Artificial Sequence
  Synthetic polynucleotide
cgccaggcaggcggagcaccccaagccaggcggagcaccccaagccctcggcctg

SEQ ID NO: 7727 - DNA, 55 bp, Artificial Sequence
  Synthetic polynucleotide
attacctatgagcacagtagaactaagtaagggtgggtggtgtagctaaagaact

SEQ ID NO: 7728 - DNA, 55 bp, Artificial Sequence
  Synthetic polynucleotide
aaatgttctgccatttggtcagaagacggacggttgcatttacccagctaccatt

SEQ ID NO: 7729 - DNA, 55 bp, Artificial Sequence
  Synthetic polynucleotide
gcgggtgggggtgcggcggaggcgggggtgcggcggaggcgggggtgcggccggc

SEQ ID NO: 7730 - DNA, 55 bp, Artificial Sequence
  Synthetic polynucleotide
gggacgggcgtaccgaggtgagcagaggcaaggcagcgagaggcccgcgctgagg

SEQ ID NO: 7731 - DNA, 55 bp, Artificial Sequence
  Synthetic polynucleotide
gcggcggggcgtgctgcgggacggcggcgagggatacaccttcacgctcacggtg

SEQ ID NO: 7732 - DNA, 55 bp, Artificial Sequence
  Synthetic polynucleotide
aaattctgggcaggtattacgagacgagactggctccatcagacccagggcaatc

SEQ ID NO: 7733 - DNA, 55 bp, Artificial Sequence
  Synthetic polynucleotide
agtaaccaggtggacagccacacagcacacaggtaaccgccctcggtattggaac

SEQ ID NO: 7734 - DNA, 55 bp, Artificial Sequence
  Synthetic polynucleotide
cggcggcgcgtgcggcggctgcggcggctgcggcggcttacggcccgcgaggcgg

SEQ ID NO: 7735 - DNA, 55 bp, Artificial Sequence
  Synthetic polynucleotide
tccccatcgtcacgccctcaggagaggtggtggtggtggccagcctcaacatcag

SEQ ID NO: 7736 - DNA, 55 bp, Artificial Sequence
  Synthetic polynucleotide
ggtccctgtccggagaaggggggaagaagtcggcgagatcttcactgtggctgta

SEQ ID NO: 7737 - DNA, 55 bp, Artificial Sequence
  Synthetic polynucleotide
gctcagcccatccagctggctggaggaaggtggaggggtgcgaggcatcggagcc

SEQ ID NO: 7738 - DNA, 55 bp, Artificial Sequence
  Synthetic polynucleotide
cctccactttcaataatggctaaacaataatggctaaagtgtttgtctggctccg

SEQ ID NO: 7739 - DNA, 55 bp, Artificial Sequence
  Synthetic polynucleotide
cggcccgcccgctcgtagatggtggcggccaggtctgtgtacatatatccaggaa

SEQ ID NO: 7740 - DNA, 55 bp, Artificial Sequence
  Synthetic polynucleotide
ggctggcggatgcgctgcaggaactgctgcgggcccagcatgaggaccaggtgga

SEQ ID NO: 7741 - DNA, 55 bp, Artificial Sequence
  Synthetic polynucleotide
agagccacggccaggtcggccaggcaggccaggcacaagtggccaatgaagacgt

SEQ ID NO: 7742 - DNA, 55 bp, Artificial Sequence
  Synthetic polynucleotide
ttgcggtaccaaggttggctgtaccaaggttggctgtaccaacatcgcctatcca

SEQ ID NO: 7743 - DNA, 55 bp, Artificial Sequence
  Synthetic polynucleotide
gcatcacactgcaggtcacctggtgagtcctggtgccagctgcccccctgtcggt

SEQ ID NO: 7744 - DNA, 55 bp, Artificial Sequence
  Synthetic polynucleotide
ggcttgctaatctcccagaggaagttatagaggaagttattcaaaagggacatag

SEQ ID NO: 7745 - DNA, 55 bp, Artificial Sequence
  Synthetic polynucleotide
gctttggctgtctcccagatgtggtggttgtggtggtgctgaactccaagaggac

SEQ ID NO: 7746 - DNA, 55 bp, Artificial Sequence
  Synthetic polynucleotide
taaagtaagtgctggatattcgggatattcgggtagtctgctttctgggtgacta

SEQ ID NO: 7747 - DNA, 55 bp, Artificial Sequence
  Synthetic polynucleotide
cttgatgatgctgatgctttgctgatgctttgggaagtatgttaatttcatggta

SEQ ID NO: 7748 - DNA, 55 bp, Artificial Sequence
  Synthetic polynucleotide
aggcagcgagaggcccgcgctgaggcggcgcggcgcagcgcaaaggggcggacgc

SEQ ID NO: 7749 - DNA, 55 bp, Artificial Sequence
  Synthetic polynucleotide
cagcaatcttgccagtgtggaagaacagtgtggaagaactaaaggtacagtcact

SEQ ID NO: 7750 - DNA, 55 bp, Artificial Sequence
  Synthetic polynucleotide
tcgtgtggatgctgttgtctttctgtctttcggtgaatgttctgaccttggttaa

SEQ ID NO: 7751 - DNA, 55 bp, Artificial Sequence
  Synthetic polynucleotide
gccctggagcccagcagggaagctggtgcagggaagctggtgcagagaagctgcc

SEQ ID NO: 7752 - DNA, 55 bp, Artificial Sequence
  Synthetic polynucleotide
cgtcttccccacacactccctggaagtccctggaagcaaagccagcgccacgttc

SEQ ID NO: 7753 - DNA, 55 bp, Artificial Sequence
  Synthetic polynucleotide
tggaggagggcacggggctgcggctgctgggggctgcggctgctggaggctgccg

SEQ ID NO: 7754 - DNA, 55 bp, Artificial Sequence
  Synthetic polynucleotide
tcgtgtcctccaccgcctcttctcttggcctggcccgactggctctggtttcctt

SEQ ID NO: 7755 - DNA, 55 bp, Artificial Sequence
  Synthetic polynucleotide
ctccggggccgaggacctgcagcgggtgggtggcctcctcccgcctccacaccac

SEQ ID NO: 7756 - DNA, 55 bp, Artificial Sequence
  Synthetic polynucleotide
tccccgcaggccccggacggtgacggcggacggtgacggtgaaggtggaactgag

SEQ ID NO: 7757 - DNA, 55 bp, Artificial Sequence
  Synthetic polynucleotide
agctcctcagccaggtccacgggcagacgacggccccaggcatcgcgcacgtcca

SEQ ID NO: 7758 - DNA, 55 bp, Artificial Sequence
  Synthetic polynucleotide
tgtgtgtggatgctcgtggtgatctgctcgtggtgctctcatcgtggctgacagt

SEQ ID NO: 7759 - DNA, 55 bp, Artificial Sequence
  Synthetic polynucleotide
agggccctgggcttcgaacccggctgctgatggctgctgatcacaggcctgttcg

SEQ ID NO: 7760 - DNA, 55 bp, Artificial Sequence
  Synthetic polynucleotide
gggaagtaaagatgagcactttatagcgcagggactatagcgcagggactcaggc

SEQ ID NO: 7761 - DNA, 55 bp, Artificial Sequence
  Synthetic polynucleotide
ctcacacagtagaccgagttcctatggatggggaaggtgcctcatctgtggggcc

SEQ ID NO: 7762 - DNA, 55 bp, Artificial Sequence
  Synthetic polynucleotide
cctggaaggaccatgtggctgcatgggacggggacgtgattttcagtaaaggtga

SEQ ID NO: 7763 - DNA, 55 bp, Artificial Sequence
  Synthetic polynucleotide
ccaggggaggtgtcggccttggggccgggccgggccgggcgggggcagggccgag

SEQ ID NO: 7764 - DNA, 55 bp, Artificial Sequence
  Synthetic polynucleotide
gatgaccggcacactctgtgcctgcgtgcgtggaggccaggcctggagtggaagg

SEQ ID NO: 7765 - DNA, 55 bp, Artificial Sequence
  Synthetic polynucleotide
tgggcaatggcagcaagctgggcggggggggggtgcagccaggatgacagcagat

SEQ ID NO: 7766 - DNA, 55 bp, Artificial Sequence
  Synthetic polynucleotide
gccacggagatgctctctgtgtagtggtagtggttccggcctttctcatacagga

SEQ ID NO: 7767 - DNA, 55 bp, Artificial Sequence
  Synthetic polynucleotide
cccacagctgggggatgcaggtggagctgttggatgcaggtggagctgttgcact

SEQ ID NO: 7768 - DNA, 55 bp, Artificial Sequence
  Synthetic polynucleotide
agctcggcggtgtttttatcaacggcaggcaggccgctgcccaaccacatccgcc

SEQ ID NO: 7769 - DNA, 55 bp, Artificial Sequence
  Synthetic polynucleotide
catcacccgcggggagacggtgtggggagacggtgtccaccccactgagcaggga

SEQ ID NO: 7770 - DNA, 55 bp, Artificial Sequence
  Synthetic polynucleotide
gaggaggagcccccccgaggagccaccccgaggagccacctgacttctgctgtcc

SEQ ID NO: 7771 - DNA, 55 bp, Artificial Sequence
  Synthetic polynucleotide
ggggcccaggatcagggccagctggccagctggccatctgttcccggctgctccg

SEQ ID NO: 7772 - DNA, 55 bp, Artificial Sequence
  Synthetic polynucleotide
taagaggtccatgctcttctgcagagggaggggtttttggtgccttgataaattg

SEQ ID NO: 7773 - DNA, 55 bp, Artificial Sequence
  Synthetic polynucleotide
ccgcaagccgttgaggtagaaagggaactagggaactgggcatactcgatgggct

SEQ ID NO: 7774 - DNA, 55 bp, Artificial Sequence
  Synthetic polynucleotide
ccttccggatgtagatcttccaggtggaggaggagtcggggttctcggcagcata

SEQ ID NO: 7775 - DNA, 55 bp, Artificial Sequence
  Synthetic polynucleotide
tcccaggacgagtttcgctgccacttccgatgggaagtgcatctctcggcagttc

SEQ ID NO: 7776 - DNA, 55 bp, Artificial Sequence
  Synthetic polynucleotide
gtatttgtttctaaggtatccctggatccctggatccctggggaaatgtggagat

SEQ ID NO: 7777 - DNA, 55 bp, Artificial Sequence
  Synthetic polynucleotide
atgatgctccagacggctaggtgctccagacggctaggtgagagtcaaatcctcg

SEQ ID NO: 7778 - DNA, 55 bp, Artificial Sequence
  Synthetic polynucleotide
aacagcagcaggatgaagaggatgatgaagaggatgatgaagaggatgatggccc

SEQ ID NO: 7779 - DNA, 55 bp, Artificial Sequence
  Synthetic polynucleotide
ggttgtagtgtgtggagagaaactggtgggtggctggaggcacagatggtggccg

SEQ ID NO: 7780 - DNA, 55 bp, Artificial Sequence
  Synthetic polynucleotide
cattgacctgcacaccgactcgctggagcttggagcttctgcagctgcagcaggt

SEQ ID NO: 7781 - DNA, 55 bp, Artificial Sequence
  Synthetic polynucleotide
ccctggctggtccggcaggtgtcgtccggcaggtgtcgtccgccgcgaacgggtg

SEQ ID NO: 7782 - DNA, 55 bp, Artificial Sequence
  Synthetic polynucleotide
tctgattgtggatctctgctgctggtggaaagggtaagaaaggacactggacaaa

SEQ ID NO: 7783 - DNA, 55 bp, Artificial Sequence
  Synthetic polynucleotide
ctttgccacagcccgggaaggggcaggggaaggggcaggggaagggtttctcgcc

SEQ ID NO: 7784 - DNA, 55 bp, Artificial Sequence
  Synthetic polynucleotide
tgctctcactggcccagcatacaggcctacaggccaccgccgagaccagggccgc

SEQ ID NO: 7785 - DNA, 55 bp, Artificial Sequence
  Synthetic polynucleotide
cagatgttctcaatgaacttacgcttggcttggtatgttatcgttggtacagacc

SEQ ID NO: 7786 - DNA, 55 bp, Artificial Sequence
  Synthetic polynucleotide
gctggagaactctgcacgctctgcaatcaatggagaggtactgtttctgacggaa

SEQ ID NO: 7787 - DNA, 55 bp, Artificial Sequence
  Synthetic polynucleotide
acgggcgcggcggcgcggtggcgcgggaggcggcgcggtggcgcgggaggctgcg

SEQ ID NO: 7788 - DNA, 55 bp, Artificial Sequence
  Synthetic polynucleotide
gggcctcgggcggcggcggggagccccgggcggcggcggggagcccaggaggcgc

SEQ ID NO: 7789 - DNA, 55 bp, Artificial Sequence
  Synthetic polynucleotide
ggtgccgcgcgacgacaagaagctggacgctggacccggactcctacaacatgtt

SEQ ID NO: 7790 - DNA, 55 bp, Artificial Sequence
  Synthetic polynucleotide
ggcgcagcagcagcggcggcgcagcagcagcggcggcggccgcggcagcggcggc

SEQ ID NO: 7791 - DNA, 55 bp, Artificial Sequence
  Synthetic polynucleotide
ctcgtcagatttgtccttgcagtcggggcggggccaccatcacagcgccagctgg

SEQ ID NO: 7792 - DNA, 55 bp, Artificial Sequence
  Synthetic polynucleotide
tacacgactgaggtgttgaatggaattgaatggaaaagattttggcactctagga

SEQ ID NO: 7793 - DNA, 55 bp, Artificial Sequence
  Synthetic polynucleotide
gcggccgcggcggctggactcacggggtggtggtggtggtggtgcggatgcgcgt

SEQ ID NO: 7794 - DNA, 55 bp, Artificial Sequence
  Synthetic polynucleotide
atgaatggcgcacttctaaactcctcccccaggcaggagccgggggacgccaggg

SEQ ID NO: 7795 - DNA, 55 bp, Artificial Sequence
  Synthetic polynucleotide
tccaccacagggagccttcgatgcggaatgcggaccttctgggttttgatctcct

SEQ ID NO: 7796 - DNA, 55 bp, Artificial Sequence
  Synthetic polynucleotide
gtggaggaagtgataattaatatgaggatgaggcacagcgtgatgacaactccag

SEQ ID NO: 7797 - DNA, 55 bp, Artificial Sequence
  Synthetic polynucleotide
gggtcttgggggggccgggattggatggattggatgggttccccgggttgttggg

SEQ ID NO: 7798 - DNA, 55 bp, Artificial Sequence
  Synthetic polynucleotide
cgtgttgacgataccggagccaatggtatccggtggcatacacaggctgctgcac

SEQ ID NO: 7799 - DNA, 55 bp, Artificial Sequence
  Synthetic polynucleotide
ttgctaagacagcacacaaaaatggaaaaatggatcaaccttaaaggaaactgct

SEQ ID NO: 7800 - DNA, 55 bp, Artificial Sequence
  Synthetic polynucleotide
ccacttgtgtgtctagatctcctcagtgggtggccgcctctactgggttgactcc

SEQ ID NO: 7801 - DNA, 55 bp, Artificial Sequence
  Synthetic polynucleotide
cgcctcctctcctcgcaggagtctgatgactggaaggtgctgaagctggttctgg

SEQ ID NO: 7802 - DNA, 55 bp, Artificial Sequence
  Synthetic polynucleotide
aagcaagggaaacgggtcgccatcgacaacgggtcgccatcgacaacacaaaccc

SEQ ID NO: 7803 - DNA, 55 bp, Artificial Sequence
  Synthetic polynucleotide
gtcaaatgcctcgaactcccgcaccagaccaggacggtgacacgggggccggcag

SEQ ID NO: 7804 - DNA, 55 bp, Artificial Sequence
  Synthetic polynucleotide
gggcccgcagcaaacttcggggggcggcggcggcggcaactccaccgcggcggcg

SEQ ID NO: 7805 - DNA, 55 bp, Artificial Sequence
  Synthetic polynucleotide
tggtgctgcagcgtgggcacgggcagtgagtggctcgttgcccccggtctcccgc

SEQ ID NO: 7806 - DNA, 55 bp, Artificial Sequence
  Synthetic polynucleotide
ccgcctcgtcgttgtaaatgggggtgtaaatgggggtgtccgcgaacttggggaa

SEQ ID NO: 7807 - DNA, 55 bp, Artificial Sequence
  Synthetic polynucleotide
tcttaaaacgctcatagagtaacgagtaactggttgtgcagtaaaagcaactggt

SEQ ID NO: 7808 - DNA, 55 bp, Artificial Sequence
  Synthetic polynucleotide
gaggaaggcttcacggctcagacggcttcacggctcagacgcaggcccgggaata

SEQ ID NO: 7809 - DNA, 55 bp, Artificial Sequence
  Synthetic polynucleotide
ggagaaacccttagacgagcagctgcatgcaggtcccctgcaacagatggatggg

SEQ ID NO: 7810 - DNA, 55 bp, Artificial Sequence
  Synthetic polynucleotide
cccaggtcatggtgatcaaacgccccgccccggcaggaagcgaaaagctgaggcc

SEQ ID NO: 7811 - DNA, 55 bp, Artificial Sequence
  Synthetic polynucleotide
tgcctccacagtggtcggaggagacgtaggaggagacctagagtttgtctgcaag

SEQ ID NO: 7812 - DNA, 55 bp, Artificial Sequence
  Synthetic polynucleotide
gggccccgtgagcaccaggcactggggctgggggctgaggagggaagggaaaagg

SEQ ID NO: 7813 - DNA, 55 bp, Artificial Sequence
  Synthetic polynucleotide
cctccccgcggagctggcgtttctgcgcagcggcgtttctgcgcagccggacctc

SEQ ID NO: 7814 - DNA, 55 bp, Artificial Sequence
  Synthetic polynucleotide
tacctaaagactggtagagctctgtcattttggtagagctctgtcattttgggat

SEQ ID NO: 7815 - DNA, 55 bp, Artificial Sequence
  Synthetic polynucleotide
ctgacctgagatggtctccttggtagcccttggtgaagaactgcatggccgaggc

SEQ ID NO: 7816 - DNA, 55 bp, Artificial Sequence
  Synthetic polynucleotide
accagcccacccacgtcaacaacggcaactaggcaactacacgctgctggctgcc

SEQ ID NO: 7817 - DNA, 55 bp, Artificial Sequence
  Synthetic polynucleotide
ttatcagctgggctaggtccaggtgcgtgctgggagcccacggtatcgtgaactc

SEQ ID NO: 7818 - DNA, 55 bp, Artificial Sequence
  Synthetic polynucleotide
cagcggctcctgtggctcctgcggctcctgcggctgctgttcccccgggtcctgt

SEQ ID NO: 7819 - DNA, 55 bp, Artificial Sequence
  Synthetic polynucleotide
tgcggagattctcttcctctgtgcgcccgccggtctctcccaggacaggcacaaa

SEQ ID NO: 7820 - DNA, 55 bp, Artificial Sequence
  Synthetic polynucleotide
gcggatgcgggtgggggtgcggcggaggtgggggtgcggcggaggcgggggtgcg

SEQ ID NO: 7821 - DNA, 55 bp, Artificial Sequence
  Synthetic polynucleotide
tgcacggaatgcagccaccaagagccggccgggccaaggacagggatgacttcaa

SEQ ID NO: 7822 - DNA, 55 bp, Artificial Sequence
  Synthetic polynucleotide
gaggaacaccacgaggccggcgatggccgatggccgagggccaggctgtgccggc

SEQ ID NO: 7823 - DNA, 55 bp, Artificial Sequence
  Synthetic polynucleotide
tgctcacggccatggggctgctggcgctgctggcgctgctgggtgagccggggcc

SEQ ID NO: 7824 - DNA, 55 bp, Artificial Sequence
  Synthetic polynucleotide
ggggcccccgcccaggccctgcagggccccaggccctgcagggccccaggccctg

SEQ ID NO: 7825 - DNA, 55 bp, Artificial Sequence
  Synthetic polynucleotide
ttgaaggtgcccacggagcggaaggtgtaaaggtgtaagagatggtaggaccccc

SEQ ID NO: 7826 - DNA, 55 bp, Artificial Sequence
  Synthetic polynucleotide
ctttccgtcaagatttaaattccaaattccaggttgtcatcaatggccgagagtt

SEQ ID NO: 7827 - DNA, 55 bp, Artificial Sequence
  Synthetic polynucleotide
ccctgaacagaagatagaaagggagaaagaaggagaggcggatggctaacaatgc

SEQ ID NO: 7828 - DNA, 55 bp, Artificial Sequence
  Synthetic polynucleotide
ttcgtggttgtcatcctctccatcgtgggtgggtgggtatacaagtcagctggac

SEQ ID NO: 7829 - DNA, 55 bp, Artificial Sequence
  Synthetic polynucleotide
ttcacttgataaaggttctgctagtgataaaggttctgctagaacatcaggcaaa

SEQ ID NO: 7830 - DNA, 55 bp, Artificial Sequence
  Synthetic polynucleotide
cccgtcgcccgggatacctgacaggggagggggttgcaagtgtcgctgctcttct

SEQ ID NO: 7831 - DNA, 55 bp, Artificial Sequence
  Synthetic polynucleotide
agtgcagcgaggtcatgagcaacatggtcatggtgtctgagaacatgctgtgtgc

SEQ ID NO: 7832 - DNA, 55 bp, Artificial Sequence
  Synthetic polynucleotide
tgcaggtgtccgtgggcctgtacacgtccgtgggcctgtacacgtccctgtgcca

SEQ ID NO: 7833 - DNA, 55 bp, Artificial Sequence
  Synthetic polynucleotide
actgatttctaaactgtcaggaaaactgtcaggaaaataagagagaacaattacc

SEQ ID NO: 7834 - DNA, 55 bp, Artificial Sequence
  Synthetic polynucleotide
cggctcctgtttgatgaaggagtgaggcggcggagtgaggcggcggcggcggggg

SEQ ID NO: 7835 - DNA, 55 bp, Artificial Sequence
  Synthetic polynucleotide
tacctggaggctgcagaacattgggaacattggtgatgacatggaccacgccatt

SEQ ID NO: 7836 - DNA, 55 bp, Artificial Sequence
  Synthetic polynucleotide
agttgacataccgggataccttggtatatatggtatatattccatatttgccttt

SEQ ID NO: 7837 - DNA, 55 bp, Artificial Sequence
  Synthetic polynucleotide
ccgcagcttcccgggccgcggcagcggcggcggcggcggccgccagggacccggt

SEQ ID NO: 7838 - DNA, 55 bp, Artificial Sequence
  Synthetic polynucleotide
tgatgaaggccaaaaatggctgggtgtagtaggagcagtgtcctcacaataaaga

SEQ ID NO: 7839 - DNA, 55 bp, Artificial Sequence
  Synthetic polynucleotide
cacaactctgcagaggcacttaactaactctggtagggacttcagtagctgtctg

SEQ ID NO: 7840 - DNA, 55 bp, Artificial Sequence
  Synthetic polynucleotide
acctccctcctgctgagttctaaggaaggaaggaaggaagtcattttccattctg

SEQ ID NO: 7841 - DNA, 55 bp, Artificial Sequence
  Synthetic polynucleotide
ttgtgagctgcactgcttgtggacaacaacaggtcaatcattttcaaaaagattc

SEQ ID NO: 7842 - DNA, 55 bp, Artificial Sequence
  Synthetic polynucleotide
tggtgctgctggacggactggtccccccccaggaccctctgtaagtaaatcactg

SEQ ID NO: 7843 - DNA, 55 bp, Artificial Sequence
  Synthetic polynucleotide
gtcatggggcccttggtgcgtcatccatcctggtgtgttcactgagtatttgctg

SEQ ID NO: 7844 - DNA, 55 bp, Artificial Sequence
  Synthetic polynucleotide
gcaggcctctaatgaactttccaggatagcaggatagcaaatagcctcacagggt

SEQ ID NO: 7845 - DNA, 55 bp, Artificial Sequence
  Synthetic polynucleotide
aagtcatctgggatgtcatctgtggatctgtggcccactggccattttcaaagtc

SEQ ID NO: 7846 - DNA, 55 bp, Artificial Sequence
  Synthetic polynucleotide
tttgcagataccctaacttagacttctttcgggtggaaaaaatctattgacagca

SEQ ID NO: 7847 - DNA, 55 bp, Artificial Sequence
  Synthetic polynucleotide
aggcagctgcatgaagcccacagggactcagggactttggtccagcatctcagca

SEQ ID NO: 7848 - DNA, 55 bp, Artificial Sequence
  Synthetic polynucleotide
ttatcctctgtgacaatggcctggggctgacggctgactggacaggggtttgctc

SEQ ID NO: 7849 - DNA, 55 bp, Artificial Sequence
  Synthetic polynucleotide
gcttgacaatacactcgcctgtgaagatgatggccacaaagagcaggttgatctt

SEQ ID NO: 7850 - DNA, 55 bp, Artificial Sequence
  Synthetic polynucleotide
ctgcagctggccagcagcagggcaacagccgggcaacagccagagggagcgtgcc

SEQ ID NO: 7851 - DNA, 55 bp, Artificial Sequence
  Synthetic polynucleotide
agcagctccacaaccacctccagcctggcctgggagataggccttgcttgctgcc

SEQ ID NO: 7852 - DNA, 55 bp, Artificial Sequence
  Synthetic polynucleotide
gcggtggacgatggaggggccggactggaggggccggactcgtcatactcctgct

SEQ ID NO: 7853 - DNA, 55 bp, Artificial Sequence
  Synthetic polynucleotide
ttgcggtggacgatggaggggccggactggaggggccggactcgtcatactcctg

SEQ ID NO: 7854 - DNA, 55 bp, Artificial Sequence
  Synthetic polynucleotide
agcccaggagcttgccctgggactccagcctgggactccaggctggagctccggt

SEQ ID NO: 7855 - DNA, 55 bp, Artificial Sequence
  Synthetic polynucleotide
atagttgtcaatcagaaggggtaatccagaaggggtaatccaatcaggttccctt

SEQ ID NO: 7856 - DNA, 55 bp, Artificial Sequence
  Synthetic polynucleotide
attcagtacaattaggtgggcttagatttgtgggcttagatttctactgactact

SEQ ID NO: 7857 - DNA, 55 bp, Artificial Sequence
  Synthetic polynucleotide
gcgtctctgaagactgctcagggctactcagggctatcctctcagagtgacattt

SEQ ID NO: 7858 - DNA, 55 bp, Artificial Sequence
  Synthetic polynucleotide
cttgtgtgtctgccgtggggcccagtcccggggcccagtcccggagccgctggaa

SEQ ID NO: 7859 - DNA, 55 bp, Artificial Sequence
  Synthetic polynucleotide
tgaggggttggccacacgggccttgacgtacgggccttgacgtgcggccctccgg

SEQ ID NO: 7860 - DNA, 55 bp, Artificial Sequence
  Synthetic polynucleotide
ctgctctccacgtcgccccggggccgccccggggccgccgacccgggctggagag

SEQ ID NO: 7861 - DNA, 55 bp, Artificial Sequence
  Synthetic polynucleotide
cctgacttacctcacggtgggccttcacggtgggcctcgctggagattttattgg

SEQ ID NO: 7862 - DNA, 55 bp, Artificial Sequence
  Synthetic polynucleotide
tctggtgccagacatcatgtgcggggatgcggggatgtctcctgtccagtacacc

SEQ ID NO: 7863 - DNA, 55 bp, Artificial Sequence
  Synthetic polynucleotide
gccgagaagttggcgatggtggcgagccggtggcgagccggtagcggcggcagct

SEQ ID NO: 7864 - DNA, 55 bp, Artificial Sequence
  Synthetic polynucleotide
gcctgttgctgttcatgatggctggcatgatggctggcatgacagtgtccatgta

SEQ ID NO: 7865 - DNA, 55 bp, Artificial Sequence
  Synthetic polynucleotide
tggctgtgccagtgctggctgtgccagagctggctgtgccagagctggtttggaa

SEQ ID NO: 7866 - DNA, 55 bp, Artificial Sequence
  Synthetic polynucleotide
cggctttgctgatgctggctgtgccagtgctggctgtgccagtgctggctgtgcc

SEQ ID NO: 7867 - DNA, 55 bp, Artificial Sequence
  Synthetic polynucleotide
cctgctctccacgtcgccccggggccgccccggggccgccgacccgggctggaga

SEQ ID NO: 7868 - DNA, 55 bp, Artificial Sequence
  Synthetic polynucleotide
gcaccggagctccagcctggagtcccaggctggagtcccagggcaagctcctggg

SEQ ID NO: 7869 - DNA, 55 bp, Artificial Sequence
  Synthetic polynucleotide
ccccctggtgaacctgggcaagctggacctgggcaagctggtccttcagtaagta

SEQ ID NO: 7870 - DNA, 55 bp, Artificial Sequence
  Synthetic polynucleotide
gcggcgcggatgctgcggacgccgggacgccgggacgccacggctacgccgccga

SEQ ID NO: 7871 - DNA, 55 bp, Artificial Sequence
  Synthetic polynucleotide
aggtcttccgggccgaggacttgccgcagagggacttgccgcagagtgcgtgggg

SEQ ID NO: 7872 - DNA, 55 bp, Artificial Sequence
  Synthetic polynucleotide
aggaagcgaaaagctgaggccgaaaagctgaggccgaccctcaggccattcccaa

SEQ ID NO: 7873 - DNA, 55 bp, Artificial Sequence
  Synthetic polynucleotide
gtctggtgccagacatcatgtgcggggatgcggggatgtctcctgtccagtacac

SEQ ID NO: 7874 - DNA, 55 bp, Artificial Sequence
  Synthetic polynucleotide
gcgtcttccagcggctccgggactgggccccgggactgggccccacggcagacac

SEQ ID NO: 7875 - DNA, 55 bp, Artificial Sequence
  Synthetic polynucleotide
cggccgccacaccatggtggacggcaccctcggcaccctcagcacccacaggcct

SEQ ID NO: 7876 - DNA, 55 bp, Artificial Sequence
  Synthetic polynucleotide
gcccggcacccgcgtccgcgccatgggccatggccatctacaagcagtcacagca

SEQ ID NO: 7877 - DNA, 55 bp, Artificial Sequence
  Synthetic polynucleotide
cgcggtgaacctggtactcctgggtctcctgggtcccctgggcctgctggtgcct

SEQ ID NO: 7878 - DNA, 55 bp, Artificial Sequence
  Synthetic polynucleotide
accagcaggcccaggggacccaggagacccaggagtaccaggttcaccgcgagga

SEQ ID NO: 7879 - DNA, 55 bp, Artificial Sequence
  Synthetic polynucleotide
gtcatcgaggtgaagacaaaaggaggatcaaggaggatccaagtacctcatctac

SEQ ID NO: 7880 - DNA, 55 bp, Artificial Sequence
  Synthetic polynucleotide
cggctgcggcaggtgcggctgcagcaggtgcggctgcaggaaggtgagctggcag

SEQ ID NO: 7881 - DNA, 55 bp, Artificial Sequence
  Synthetic polynucleotide
gcgcgtatcattccagttacctccatggcatggcgactacgtccagagcacttcc

SEQ ID NO: 7882 - DNA, 55 bp, Artificial Sequence
  Synthetic polynucleotide
aatgacaattctcacatggtggagagtggaaggtggagagtggaaggtagacagt

SEQ ID NO: 7883 - DNA, 55 bp, Artificial Sequence
  Synthetic polynucleotide
ccttgtgtgtctgccgtggggcccagtcccggggcccagtcccggagccgctgga

SEQ ID NO: 7884 - DNA, 55 bp, Artificial Sequence
  Synthetic polynucleotide
tcgtcagatttgtccttgcagtcggcagtcggggccaccatcacagcgccagctg

SEQ ID NO: 7885 - DNA, 55 bp, Artificial Sequence
  Synthetic polynucleotide
ggatctaccggcttgggccggggcggtttggggcggtttggggcgcagatagccg

SEQ ID NO: 7886 - DNA, 55 bp, Artificial Sequence
  Synthetic polynucleotide
tctcgcggatcgccatggcgatgagcgccacggcgatgagcgccacgtacgagta

SEQ ID NO: 7887 - DNA, 55 bp, Artificial Sequence
  Synthetic polynucleotide
accttgtgtgtctgccgtggggcccagtcccggggcccagtcccggagccgctgg

SEQ ID NO: 7888 - DNA, 55 bp, Artificial Sequence
  Synthetic polynucleotide
cgtggtgcggtggggcaggcggcggtgcggcggtgcggcggccgcgtgcagatgg

SEQ ID NO: 7889 - DNA, 55 bp, Artificial Sequence
  Synthetic polynucleotide
ctagcatgaagacggtgaagacggtgaagacggttttctcggtggggcgggacac

SEQ ID NO: 7890 - DNA, 55 bp, Artificial Sequence
  Synthetic polynucleotide
ctggagtcacccttcccagtgaggcaggcaggggtcgttaggggaggtgatacgc

SEQ ID NO: 7891 - DNA, 55 bp, Artificial Sequence
  Synthetic polynucleotide
cccactcatcagacagtgaggaggaagaagaggaggaagaagaggaggaggaaga

SEQ ID NO: 7892 - DNA, 55 bp, Artificial Sequence
  Synthetic polynucleotide
cgtaagtgataaaagccagggataaaagccagggacagcaggaccgcagccaggt

SEQ ID NO: 7893 - DNA, 55 bp, Artificial Sequence
  Synthetic polynucleotide
aagcggggctgaactttgcagacgaggacgaggacgaggcccaggccttccgggc

SEQ ID NO: 7894 - DNA, 55 bp, Artificial Sequence
  Synthetic polynucleotide
tacgaaggcctgtgggtgctgagggtgccgagggtgccgtccaccatggtgtggc

SEQ ID NO: 7895 - DNA, 55 bp, Artificial Sequence
  Synthetic polynucleotide
gccacgggctgggccgggccgggcagggcagggggctaccaccccgcgccgcaga

SEQ ID NO: 7896 - DNA, 55 bp, Artificial Sequence
  Synthetic polynucleotide
gtccctttggtgacgtgggctgggccgggccgggcccaggaagtgaggcggcgct

SEQ ID NO: 7897 - DNA, 55 bp, Artificial Sequence
  Synthetic polynucleotide
acgcgactcgaggctgtgcgggaaatgtgcgggaaatgtcggagacccatcactg

SEQ ID NO: 7898 - DNA, 55 bp, Artificial Sequence
  Synthetic polynucleotide
ttcagcagcctcaccagtgtgggcttcgtgtgggcttcggcaacgtctctcccaa

SEQ ID NO: 7899 - DNA, 55 bp, Artificial Sequence
  Synthetic polynucleotide
gaggacgctgactgcgctgagggcccgctgagggcccgctgccgtgctcctggct

SEQ ID NO: 7900 - DNA, 55 bp, Artificial Sequence
  Synthetic polynucleotide
aggacgctgactgcgctgagggcccgctgagggcccgctgccgtgctcctggctc

SEQ ID NO: 7901 - DNA, 55 bp, Artificial Sequence
  Synthetic polynucleotide
gccagctttgagtacactatcctggaatcctggaccccagctcccagctcttgcg

SEQ ID NO: 7902 - DNA, 55 bp, Artificial Sequence
  Synthetic polynucleotide
gagccaggagcacggcagcgggccctcagcgggccctcagcgcagtcagcgtcct

SEQ ID NO: 7903 - DNA, 55 bp, Artificial Sequence
  Synthetic polynucleotide
tacgaagaccatcagtgcgaggtcggcatgaggtcggcatgatcgtgggtaaggg

SEQ ID NO: 7904 - DNA, 55 bp, Artificial Sequence
  Synthetic polynucleotide
tgctgcagcggctggcagacggggccagacggggccatcgacctctatgccatgg

SEQ ID NO: 7905 - DNA, 55 bp, Artificial Sequence
  Synthetic polynucleotide
gagtccgctgctgtagtcgtgggcagtcgtgggcagccgccggcacataggaggg

SEQ ID NO: 7906 - DNA, 55 bp, Artificial Sequence
  Synthetic polynucleotide
ggaaaactgcggtatgggcggggccagggcggggccagggtgggggcggggcgtc

SEQ ID NO: 7907 - DNA, 55 bp, Artificial Sequence
  Synthetic polynucleotide
cctttgagatgctgatcctgggccgcttctgggccgcttcatcatcggtgtgtac

SEQ ID NO: 7908 - DNA, 55 bp, Artificial Sequence
  Synthetic polynucleotide
gggcgcgcagggcggcgcgggcctcccgcgcgggcctcccggcgcaggcggcgct

SEQ ID NO: 7909 - DNA, 55 bp, Artificial Sequence
  Synthetic polynucleotide
agggtcagcagggtcagcctggaggcctggaggccatctgggcggcgacgtcagc

SEQ ID NO: 7910 - DNA, 55 bp, Artificial Sequence
  Synthetic polynucleotide
gctctggcacttgcttcaggcccttgcttcaggcccttgtgtctatgtgtataag

SEQ ID NO: 7911 - DNA, 55 bp, Artificial Sequence
  Synthetic polynucleotide
ggagccctggctggtccggcaggtgtcgtccggcaggtgtcgtccgccgcgaacg

SEQ ID NO: 7912 - DNA, 55 bp, Artificial Sequence
  Synthetic polynucleotide
ggacgccccgcccccaccctggccccgccctggccccgcccataccgcagttttc

SEQ ID NO: 7913 - DNA, 55 bp, Artificial Sequence
  Synthetic polynucleotide
catgagcctggacatggggcaaccttctcggggcaaccttctcaggccaacacta

SEQ ID NO: 7914 - DNA, 55 bp, Artificial Sequence
  Synthetic polynucleotide
agagcgccgcctgcgccgggaggcccgcgcgggaggcccgcgccgccctgcgcgc

SEQ ID NO: 7915 - DNA, 55 bp, Artificial Sequence
  Synthetic polynucleotide
gccctgcgtcccaagaccgggtctcaagaccgggtctcaagaccaggtgagtggg

SEQ ID NO: 7916 - DNA, 55 bp, Artificial Sequence
  Synthetic polynucleotide
tagtggccatgcacgtggcctaccggagaccggagacatgagaagaagaggaagt

SEQ ID NO: 7917 - DNA, 55 bp, Artificial Sequence
  Synthetic polynucleotide
tccctttcttcatcagtggggcgctggagtggggcgctggagtccaagggattgt

SEQ ID NO: 7918 - DNA, 55 bp, Artificial Sequence
  Synthetic polynucleotide
tgggtttttaaaaatcgttttagggttttagggtcttactacggagcacatttgc

SEQ ID NO: 7919 - DNA, 55 bp, Artificial Sequence
  Synthetic polynucleotide
atggtccagcagggcagccaggacgccgccaggacgccgccagcactgcccggag

SEQ ID NO: 7920 - DNA, 55 bp, Artificial Sequence
  Synthetic polynucleotide
ttccctttcttcatcagtggggcgctggagtggggcgctggagtccaagggattg

SEQ ID NO: 7921 - DNA, 55 bp, Artificial Sequence
  Synthetic polynucleotide
cggactttgtggcggaactgggggcggaactgggggcggcacaggggctcagtca

SEQ ID NO: 7922 - DNA, 55 bp, Artificial Sequence
  Synthetic polynucleotide
gctgcagcggctggcagacggggccagacggggccatcgacctctatgccatggt

SEQ ID NO: 7923 - DNA, 55 bp, Artificial Sequence
  Synthetic polynucleotide
cctttgtagagagtgttcatctgggaatctgggacttggatgagacaatcattgt

SEQ ID NO: 7924 - DNA, 55 bp, Artificial Sequence
  Synthetic polynucleotide
aggaaaactgcggtatgggcggggccagggcggggccagggtgggggcggggcgt

SEQ ID NO: 7925 - DNA, 55 bp, Artificial Sequence
  Synthetic polynucleotide
ttcacaccgaagctcaaggtggagacaaggtggagacggacatggaatcttcact

SEQ ID NO: 7926 - DNA, 55 bp, Artificial Sequence
  Synthetic polynucleotide
agcgccccctcgcggtgcggtccgggactgcggtccgggactgcgcccctgcgca

SEQ ID NO: 7927 - DNA, 55 bp, Artificial Sequence
  Synthetic polynucleotide
cggaggacgtggtggcctttgcggcctctgcggcctctgtggcccacctctactc

SEQ ID NO: 7928 - DNA, 55 bp, Artificial Sequence
  Synthetic polynucleotide
actttccatgactggatcacagggatcacagggaaaaaccgaccgagctcaggaa

SEQ ID NO: 7929 - DNA, 55 bp, Artificial Sequence
  Synthetic polynucleotide
caccgataggcatgaagggctgggaggcaagggctgggaggcagggctgggcctg

SEQ ID NO: 7930 - DNA, 55 bp, Artificial Sequence
  Synthetic polynucleotide
gggtgtgctggaaaagggtccagatggaaaagggtccagatgatatgttctaatt

SEQ ID NO: 7931 - DNA, 55 bp, Artificial Sequence
  Synthetic polynucleotide
ccgggtcggcggccccggggcgacggccccggggcgacgtggagagcaggctgga

SEQ ID NO: 7932 - DNA, 55 bp, Artificial Sequence
  Synthetic polynucleotide
caggggtgaactcggcggggaggtgctcggcggggaggtgggcggccagggtcac

SEQ ID NO: 7933 - DNA, 55 bp, Artificial Sequence
  Synthetic polynucleotide
ccctcgcggtgcggtccgggactgcggtccgggactgcgcccctgcgcaccgctc

SEQ ID NO: 7934 - DNA, 55 bp, Artificial Sequence
  Synthetic polynucleotide
gggtccgcaggagatgagaaggggaggagaaggggaggagaattcgtggagctgc

SEQ ID NO: 7935 - DNA, 55 bp, Artificial Sequence
  Synthetic polynucleotide
aacaggatctgctgggatgctgggccccgctgggccccacttgaaacggttcctc

SEQ ID NO: 7936 - DNA, 55 bp, Artificial Sequence
  Synthetic polynucleotide
gggcggccgcaaccggggcactgcagctaccggggcactgcagctgccgccgccg

SEQ ID NO: 7937 - DNA, 55 bp, Artificial Sequence
  Synthetic polynucleotide
ttggataggcgatgttggtacagccaaccttggtacagccaaccttggtaccgca

SEQ ID NO: 7938 - DNA, 55 bp, Artificial Sequence
  Synthetic polynucleotide
cgtcgccgcccagatggcctccaggcctccaggctgaccctgctgaccctcctgc

SEQ ID NO: 7939 - DNA, 55 bp, Artificial Sequence
  Synthetic polynucleotide
tgcggatgcgggtgggggtgcggcggaggtgggggtgcggcggaggcgggggtgc

SEQ ID NO: 7940 - DNA, 55 bp, Artificial Sequence
  Synthetic polynucleotide
ccagggagcgcgggggcttctttagcccgggggcttctttagcccggaacccggt

SEQ ID NO: 7941 - DNA, 55 bp, Artificial Sequence
  Synthetic polynucleotide
tgtttccagtagcagctgacagagggttagagggttattcaacagcccgcccaag

SEQ ID NO: 7942 - DNA, 55 bp, Artificial Sequence
  Synthetic polynucleotide
ggaaccagcaggaccgggagcaccaggaccgggagcaccagcagggccagcaggg

SEQ ID NO: 7943 - DNA, 55 bp, Artificial Sequence
  Synthetic polynucleotide
cagccgggaacagatggccagctggccagctggccctgatcctgggccccgtgct

SEQ ID NO: 7944 - DNA, 55 bp, Artificial Sequence
  Synthetic polynucleotide
ggactttgtggcggaactgggggcggaactgggggcggcacaggggctcagtcag

SEQ ID NO: 7945 - DNA, 55 bp, Artificial Sequence
  Synthetic polynucleotide
gtgcggatgcgggtgggggtgcggcggaggtgggggtgcggcggaggcgggggtg

SEQ ID NO: 7946 - DNA, 55 bp, Artificial Sequence
  Synthetic polynucleotide
tgtgctagggatgcttccaaggccattccaaggccattccaagaaggactagaag

SEQ ID NO: 7947 - DNA, 55 bp, Artificial Sequence
  Synthetic polynucleotide
cggatgcgggtgggggtgcggcggaggtgggggtgcggcggaggcgggggtgcgg

SEQ ID NO: 7948 - DNA, 55 bp, Artificial Sequence
  Synthetic polynucleotide
ctggctgttgccctgctgctggccagctgctggccagctgcagcctcagccccac

SEQ ID NO: 7949 - DNA, 55 bp, Artificial Sequence
  Synthetic polynucleotide
ttcctcctggtggttgggatggggctggatggggctggctggggccttcctggcc

SEQ ID NO: 7950 - DNA, 55 bp, Artificial Sequence
  Synthetic polynucleotide
ggtgcggcggaggcgggggtgcggccgaggcgggggtgcggccggcgggcctccc

SEQ ID NO: 7951 - DNA, 55 bp, Artificial Sequence
  Synthetic polynucleotide
cgcaggagatgagaaggggaggagaaggggaggagaattcgtggagctgccggtg

SEQ ID NO: 7952 - DNA, 55 bp, Artificial Sequence
  Synthetic polynucleotide
caattcaccagcaaggatgccttcagagcaaggatgccttcagagtgcatataag

SEQ ID NO: 7953 - DNA, 55 bp, Artificial Sequence
  Synthetic polynucleotide
ttcattgttcgctgaaggggaaggctcgaaggggaaggctcgcaagcgatgtaga

SEQ ID NO: 7954 - DNA, 55 bp, Artificial Sequence
  Synthetic polynucleotide
cgcgagactacgaaggcctgtgggtgctgtgggtgctgagggtgccgtccaccat

SEQ ID NO: 7955 - DNA, 55 bp, Artificial Sequence
  Synthetic polynucleotide
gaaggtggcagcacggctcaggtgccagcacggctcaggtgccagcacccacagc

SEQ ID NO: 7956 - DNA, 55 bp, Artificial Sequence
  Synthetic polynucleotide
ctcaccgggttccgggctaaagaagcccccgggctaaagaagcccccgcgctccc

SEQ ID NO: 7957 - DNA, 55 bp, Artificial Sequence
  Synthetic polynucleotide
ggacagcagaagtcaggtggctcctcggggtggctcctcgggggggctcctcctc

SEQ ID NO: 7958 - DNA, 55 bp, Artificial Sequence
  Synthetic polynucleotide
cccagggagcgcgggggcttctttagcccgggggcttctttagcccggaacccgg

SEQ ID NO: 7959 - DNA, 55 bp, Artificial Sequence
  Synthetic polynucleotide
ggattttgtgcatctggtggaatggggccctggtggaatggggccctcttttttc

SEQ ID NO: 7960 - DNA, 55 bp, Artificial Sequence
  Synthetic polynucleotide
tcctttgagatgctgatcctgggccgcttctgggccgcttcatcatcggtgtgta

SEQ ID NO: 7961 - DNA, 55 bp, Artificial Sequence
  Synthetic polynucleotide
tcttcccgcagcccgggaaggggcatgggaaggggcatgggaagggcttctcgcc

SEQ ID NO: 7962 - DNA, 55 bp, Artificial Sequence
  Synthetic polynucleotide
gcagggagccagcagaccagggccccaccagggccccgggatgcccaggcacacc

SEQ ID NO: 7963 - DNA, 55 bp, Artificial Sequence
  Synthetic polynucleotide
gctgaggtgtttccctttgaggatccagataggatccagattagtcaattcagca

SEQ ID NO: 7964 - DNA, 55 bp, Artificial Sequence
  Synthetic polynucleotide
gtccgcaggagatgagaaggggaggagaaggggaggagaattcgtggagctgccg

SEQ ID NO: 7965 - DNA, 55 bp, Artificial Sequence
  Synthetic polynucleotide
ggtgtgcctgggcatcccggggccctggtggggccctggtctgctggctccctgc

SEQ ID NO: 7966 - DNA, 55 bp, Artificial Sequence
  Synthetic polynucleotide
ggggcccgggggcccgggaggcgaaccccccgggaggcgaacccggcaagggcgg

SEQ ID NO: 7967 - DNA, 55 bp, Artificial Sequence
  Synthetic polynucleotide
gaagcaagggaaacgggtcgccatcgacaacgggtcgccatcgacaacacaaacc

SEQ ID NO: 7968 - DNA, 55 bp, Artificial Sequence
  Synthetic polynucleotide
gcaggtgtccgtgggcctgtacacgtccgtgggcctgtacacgtccctgtgccag

SEQ ID NO: 7969 - DNA, 55 bp, Artificial Sequence
  Synthetic polynucleotide
ccagctccgggaatggaccagccccgggaatggaccagcccctcccccactccct

SEQ ID NO: 7970 - DNA, 55 bp, Artificial Sequence
  Synthetic polynucleotide
tcacgtcgtagcggtgcatgggctgcgcatgggctgcatctgcgctgcgccgtgc

SEQ ID NO: 7971 - DNA, 55 bp, Artificial Sequence
  Synthetic polynucleotide
aagacctccggatggttttggtggaggaagtggaggaagtgataattaatatgag

SEQ ID NO: 7972 - DNA, 55 bp, Artificial Sequence
  Synthetic polynucleotide
ccctgcgcgccgcgggcgtcctgctcgccgcgggcgtcctgctccgcgatccgcg

SEQ ID NO: 7973 - DNA, 55 bp, Artificial Sequence
  Synthetic polynucleotide
ggaagtgcgcgggcggcggccggaagggcgcggccggaagggcctcttcatgcgg

SEQ ID NO: 7974 - DNA, 55 bp, Artificial Sequence
  Synthetic polynucleotide
cttaccagccatatcagtctgtgggactgtgggatctggtacagttttgtaaatt

SEQ ID NO: 7975 - DNA, 55 bp, Artificial Sequence
  Synthetic polynucleotide
cgcaggcggtcggcgggcgcagccggtcggcgggcgcagccggcggctccgagga

SEQ ID NO: 7976 - DNA, 55 bp, Artificial Sequence
  Synthetic polynucleotide
tagagcgccgcctgcgccgggaggcccgcgcgggaggcccgcgccgccctgcgcg

SEQ ID NO: 7977 - DNA, 55 bp, Artificial Sequence
  Synthetic polynucleotide
tgcatcgctgaaagggccttcctgaggaaagggccttcctgaggcacctggtagg

SEQ ID NO: 7978 - DNA, 55 bp, Artificial Sequence
  Synthetic polynucleotide
ggcagcacggctcaggtgccagcacggctcaggtgccagcacccacagcatcacc

SEQ ID NO: 7979 - DNA, 55 bp, Artificial Sequence
  Synthetic polynucleotide
gtactgtttctgacggaacttgcgctccaggggaacttgcgctccagggcgagga

SEQ ID NO: 7980 - DNA, 55 bp, Artificial Sequence
  Synthetic polynucleotide
ggtgcggcggaggcgggggtgcggccggggcgggggtgcggccggcgggcctccc

SEQ ID NO: 7981 - DNA, 55 bp, Artificial Sequence
  Synthetic polynucleotide
tgcggcggaggcgggggtgcggccggggcgggggtgcggccggcgggcctcccag

SEQ ID NO: 7982 - DNA, 55 bp, Artificial Sequence
  Synthetic polynucleotide
gtgcggcggaggcgggggtgcggccgaggcgggggtgcggccggcgggcctccca

SEQ ID NO: 7983 - DNA, 55 bp, Artificial Sequence
  Synthetic polynucleotide
cacgtccacgccgggcagggccacacgcgccgggcagggccacacgcgctgggcg

SEQ ID NO: 7984 - DNA, 55 bp, Artificial Sequence
  Synthetic polynucleotide
gggccaggcaagggggcggaggcctggcaagggggcggaggcctgggaggcaccg

SEQ ID NO: 7985 - DNA, 55 bp, Artificial Sequence
  Synthetic polynucleotide
cgcctcgtcgttgtaaatgggggtgtaaatgggggtgtccgcgaacttggggaag

SEQ ID NO: 7986 - DNA, 55 bp, Artificial Sequence
  Synthetic polynucleotide
gcccctttgacgggggcatctatgtctgcgggggcatctatgtctgcagggccac

SEQ ID NO: 7987 - DNA, 55 bp, Artificial Sequence
  Synthetic polynucleotide
caacagaaaaaagagggccccattccaccagggccccattccaccagatgcacaa

SEQ ID NO: 7988 - DNA, 55 bp, Artificial Sequence
  Synthetic polynucleotide
cggatgcgggtgggggtgcggcggaggcgggggtgcggcggaggcgggggtgcgg

SEQ ID NO: 7989 - DNA, 55 bp, Artificial Sequence
  Synthetic polynucleotide
ggaggaggtggtgcggcgggaggaggcggcgggaggaggcggcggtggacgcgca

SEQ ID NO: 7990 - DNA, 55 bp, Artificial Sequence
  Synthetic polynucleotide
cgggtcggcggccccggggcgacggccccggggcgacgtggagagcaggctggat

SEQ ID NO: 7991 - DNA, 55 bp, Artificial Sequence
  Synthetic polynucleotide
acgtccacgccgggcagggccacacgcgccgggcagggccacacgcgctgggcgc

SEQ ID NO: 7992 - DNA, 55 bp, Artificial Sequence
  Synthetic polynucleotide
ttagagaacgatgggagcagcaggtgtcgatgggagcagcaggtgtcggcagcag

SEQ ID NO: 7993 - DNA, 55 bp, Artificial Sequence
  Synthetic polynucleotide
cctgaagtattcattatagtcaagggcataagggcatatcctacaacaaacttgt

SEQ ID NO: 7994 - DNA, 55 bp, Artificial Sequence
  Synthetic polynucleotide
gttggccgccagagctcctcggacgctcctcggacagcggcatcgccactggcag

SEQ ID NO: 7995 - DNA, 55 bp, Artificial Sequence
  Synthetic polynucleotide
ggtcctgtgccgggagacggggctggagacggggctgctggccctgcactcggcc

SEQ ID NO: 7996 - DNA, 55 bp, Artificial Sequence
  Synthetic polynucleotide
ctgctgcccggccgccggcccgcgggcccgcgggccccgggtcccccgcgacgtc

SEQ ID NO: 7997 - DNA, 55 bp, Artificial Sequence
  Synthetic polynucleotide
tcctcctggtggttgggatggggctggatggggctggctggggccttcctggccc

SEQ ID NO: 7998 - DNA, 55 bp, Artificial Sequence
  Synthetic polynucleotide
tgccgcgtcaactgctcgggccgcgggccgcgggctgcggacgctcggtcccgcg

SEQ ID NO: 7999 - DNA, 55 bp, Artificial Sequence
  Synthetic polynucleotide
acctgcactgggaccccggggcaccgggagcggggcaccgggagcggggctccgg

SEQ ID NO: 8000 - DNA, 55 bp, Artificial Sequence
  Synthetic polynucleotide
tttcattgttcgctgaaggggaaggctcgaaggggaaggctcgcaagcgatgtag

SEQ ID NO: 8001 - DNA, 55 bp, Artificial Sequence
  Synthetic polynucleotide
ggaggtggtgcggcgggaggaggcggcgggaggaggcggcggtggacgcgcagca

SEQ ID NO: 8002 - DNA, 55 bp, Artificial Sequence
  Synthetic polynucleotide
ggccgtgctgtccctctacgcctccgcctccggcaggaccaccggtgagtgcccg

SEQ ID NO: 8003 - DNA, 55 bp, Artificial Sequence
  Synthetic polynucleotide
gcagctccacaaccacctccagcctggcctgggagataggccttgcttgctgcct

SEQ ID NO: 8004 - DNA, 55 bp, Artificial Sequence
  Synthetic polynucleotide
cacagatcgagctggagatctcggaggcatcggaggcagccagccctggcacgcg

SEQ ID NO: 8005 - DNA, 55 bp, Artificial Sequence
  Synthetic polynucleotide
atttttgcaaatggatcttacagggttacagggttacaggtgatttaggtaactg

SEQ ID NO: 8006 - DNA, 55 bp, Artificial Sequence
  Synthetic polynucleotide
ggcggcgcagcgcaaaggggcggacgctgagggcggacgctgagggcggccaggg

SEQ ID NO: 8007 - DNA, 55 bp, Artificial Sequence
  Synthetic polynucleotide
gtgctatggagaaggggaaattgcacaagccgggaaattgcacaagccaggaaag

SEQ ID NO: 8008 - DNA, 55 bp, Artificial Sequence
  Synthetic polynucleotide
ttcccgcagcccgggaaggggcatgggaaggggcatgggaagggcttctcgcccg

SEQ ID NO: 8009 - DNA, 55 bp, Artificial Sequence
  Synthetic polynucleotide
caggagcgccctgttctgaaggcaggtgcaaggcaggtgcagcatggctggcttc

SEQ ID NO: 8010 - DNA, 55 bp, Artificial Sequence
  Synthetic polynucleotide
ggccgagggcttggggtgctccgcctggcttggggtgctccgcctgcctggcgtc

SEQ ID NO: 8011 - DNA, 55 bp, Artificial Sequence
  Synthetic polynucleotide
gagaccatgttccgagcggcggctccggggcggctccggggcagctccggcgggc

SEQ ID NO: 8012 - DNA, 55 bp, Artificial Sequence
  Synthetic polynucleotide
tcgcgggggacccggggcccgcgggcccgcgggccggcggccgggcagcagctgc

SEQ ID NO: 8013 - DNA, 55 bp, Artificial Sequence
  Synthetic polynucleotide
cgtctctcggcccggcggcacacggcccggcggcacacggcccggcagaaatgca

SEQ ID NO: 8014 - DNA, 55 bp, Artificial Sequence
  Synthetic polynucleotide
cacgcacaccatctgcacgcggccgccgcgcggccgccgcaccgccgcctgcccc

SEQ ID NO: 8015 - DNA, 55 bp, Artificial Sequence
  Synthetic polynucleotide
cctgcgcgccgcgggcgtcctgctcgccgcgggcgtcctgctccgcgatccgcgt

SEQ ID NO: 8016 - DNA, 55 bp, Artificial Sequence
  Synthetic polynucleotide
gccgccatgcaggcgcagcagggccgcagcagggccgcagcagcctggtgtggct

SEQ ID NO: 8017 - DNA, 55 bp, Artificial Sequence
  Synthetic polynucleotide
acccgggggaacagcagccgcaggagccgcaggagccacaggagccgctgcagga

SEQ ID NO: 8018 - DNA, 55 bp, Artificial Sequence
  Synthetic polynucleotide
atccaagcaaaatggcacctggccccaaaatggcacctggccccgagaggtgctt

SEQ ID NO: 8019 - DNA, 55 bp, Artificial Sequence
  Synthetic polynucleotide
tttgccacagcccgggaaggggcaggggaaggggcaggggaagggtttctcgcct

SEQ ID NO: 8020 - DNA, 55 bp, Artificial Sequence
  Synthetic polynucleotide
ccctcctctgttgctgcagatccgtgggcgtgggcgtgagcgcttcgagatgttc

SEQ ID NO: 8021 - DNA, 55 bp, Artificial Sequence
  Synthetic polynucleotide
tgcagctcgggagaggagctggacttgctcaggagctggacttgctcaggggctg

SEQ ID NO: 8022 - DNA, 55 bp, Artificial Sequence
  Synthetic polynucleotide
agggagtgggggaggggctggtccattcccggggctggtccattcccggagctgg

SEQ ID NO: 8023 - DNA, 55 bp, Artificial Sequence
  Synthetic polynucleotide
ctgtctgggtgtgctcactctgccaggccagggcctgcggtccaatgtcctcttg

SEQ ID NO: 8024 - DNA, 55 bp, Artificial Sequence
  Synthetic polynucleotide
ccgccatgcaggcgcagcagggccgcagcagggccgcagcagcctggtgtggctc

SEQ ID NO: 8025 - DNA, 55 bp, Artificial Sequence
  Synthetic polynucleotide
ggcttgggccggggcggtttggggcggtttggggcgcagatagccgtgcagcgcg

SEQ ID NO: 8026 - DNA, 55 bp, Artificial Sequence
  Synthetic polynucleotide
tgcagcagcgccgcgggagcgagggagcgagggagccagggctgcgggtgtggcg

SEQ ID NO: 8027 - DNA, 55 bp, Artificial Sequence
  Synthetic polynucleotide
gataggcatgaagggctgggaggcaagggctgggaggcagggctgggcctggaca

SEQ ID NO: 8028 - DNA, 55 bp, Artificial Sequence
  Synthetic polynucleotide
cctgcactgggaccccggggcaccgggagcggggcaccgggagcggggctccggc

SEQ ID NO: 8029 - DNA, 55 bp, Artificial Sequence
  Synthetic polynucleotide
gtcgcgggggacccggggcccgcgggcccgcgggccggcggccgggcagcagctg

SEQ ID NO: 8030 - DNA, 55 bp, Artificial Sequence
  Synthetic polynucleotide
gcctcgtcgttgtaaatgggggtgtaaatgggggtgtccgcgaacttggggaaga

SEQ ID NO: 8031 - DNA, 55 bp, Artificial Sequence
  Synthetic polynucleotide
gagcgccctgttctgaaggcaggtgaaggcaggtgcagcatggctggcttcccca

SEQ ID NO: 8032 - DNA, 55 bp, Artificial Sequence
  Synthetic polynucleotide
cttcgatccagggcaaggaggtggggttgtggggttcagtgaggacagggctgag

SEQ ID NO: 8033 - DNA, 55 bp, Artificial Sequence
  Synthetic polynucleotide
agtcctcagcaaggtgcaggtgggtgcaggtgggtggagtactaggaaaaagcac

SEQ ID NO: 8034 - DNA, 55 bp, Artificial Sequence
  Synthetic polynucleotide
gcgaggccggcggcgggctcgggctgcggcgggctcgggctgcggcgcggcgctg

SEQ ID NO: 8035 - DNA, 55 bp, Artificial Sequence
  Synthetic polynucleotide
tacttgctgcggcagccggcggaccagaggcggaccagaggcggaccacgtactc

SEQ ID NO: 8036 - DNA, 55 bp, Artificial Sequence
  Synthetic polynucleotide
tgcccctttgacgggggcatctatgtctgcgggggcatctatgtctgcagggcca

SEQ ID NO: 8037 - DNA, 55 bp, Artificial Sequence
  Synthetic polynucleotide
caccctcatcacccgcggggagacggtgtggggagacggtgtccaccccactgag

SEQ ID NO: 8038 - DNA, 55 bp, Artificial Sequence
  Synthetic polynucleotide
gtccacttcccctatgcaggtgtccaacggaggtgtccaacggatgtgtgagtaa

SEQ ID NO: 8039 - DNA, 55 bp, Artificial Sequence
  Synthetic polynucleotide
tctgcagggtgtgctggaaaagggtccagatggaaaagggtccagatgatatgtt

SEQ ID NO: 8040 - DNA, 55 bp, Artificial Sequence
  Synthetic polynucleotide
gtcaggatgcatgggcatgcagggcatgcagggctgccgctccaccacaaaggca

SEQ ID NO: 8041 - DNA, 55 bp, Artificial Sequence
  Synthetic polynucleotide
aggggtgaactcggcggggaggtgctcggcggggaggtgggcggccagggtcacc

SEQ ID NO: 8042 - DNA, 55 bp, Artificial Sequence
  Synthetic polynucleotide
gccgagggcttggggtgctccgcctggcttggggtgctccgcctgcctggcgtcc

SEQ ID NO: 8043 - DNA, 55 bp, Artificial Sequence
  Synthetic polynucleotide
gcttgacgtagggcacatctgggtgcatctgggtgatacttgggtggcttgaaca

SEQ ID NO: 8044 - DNA, 55 bp, Artificial Sequence
  Synthetic polynucleotide
gtggcgctggctttgcttccagggacttccagggagtgtgtggggaagacggtga

SEQ ID NO: 8045 - DNA, 55 bp, Artificial Sequence
  Synthetic polynucleotide
ccggaccaaccgcggggccccggggccccggggccaggcgcgcagcagcaggcgg

SEQ ID NO: 8046 - DNA, 55 bp, Artificial Sequence
  Synthetic polynucleotide
ggagcaggaggaggtgggggctggggcgtgggggctggggcttggggccacagac

SEQ ID NO: 8047 - DNA, 55 bp, Artificial Sequence
  Synthetic polynucleotide
cctgctgctgcgcgcctggccccggggccccggggccccgcggttggtccgggag

SEQ ID NO: 8048 - DNA, 55 bp, Artificial Sequence
  Synthetic polynucleotide
ccatgagcctggacatggggcaaccttctcggggcaaccttctcaggccaacact

SEQ ID NO: 8049 - DNA, 55 bp, Artificial Sequence
  Synthetic polynucleotide
cccgggggcccgggaggcgaaccccccgggaggcgaacccggcaagggcggcgca

SEQ ID NO: 8050 - DNA, 55 bp, Artificial Sequence
  Synthetic polynucleotide
ttcctttgcctgggggtcttcctttgcctgggggtcttccttctatggaagaact

SEQ ID NO: 8051 - DNA, 55 bp, Artificial Sequence
  Synthetic polynucleotide
gggtgtgcctgggcatcccggggccctggtggggccctggtctgctggctccctg

SEQ ID NO: 8052 - DNA, 55 bp, Artificial Sequence
  Synthetic polynucleotide
gggagcaggaggaggtgggggctggggcgtgggggctggggcttggggccacaga

SEQ ID NO: 8053 - DNA, 55 bp, Artificial Sequence
  Synthetic polynucleotide
gcatgtccttggggccctgggggaagcctgggggaagccagggggaagccaggag

SEQ ID NO: 8054 - DNA, 55 bp, Artificial Sequence
  Synthetic polynucleotide
agaggtacggggcccggggaccaggggaccagggtggccgggagccggcgagcag

SEQ ID NO: 8055 - DNA, 55 bp, Artificial Sequence
  Synthetic polynucleotide
gcgatggcggcggggctggcgcggctggcgcggctcctgttgctcctcgggctct

SEQ ID NO: 8056 - DNA, 55 bp, Artificial Sequence
  Synthetic polynucleotide
tgctgctgcgcgcctggccccggggccccggggccccgcggttggtccgggagcc

SEQ ID NO: 8057 - DNA, 55 bp, Artificial Sequence
  Synthetic polynucleotide
aaatggtccaacagaaaaaagagggaaagagggccccattccaccagatgcacaa

SEQ ID NO: 8058 - DNA, 55 bp, Artificial Sequence
  Synthetic polynucleotide
cctcgccacacagggtgctcacggccatgcgggtgctcacggccatgcccaggaa

SEQ ID NO: 8059 - DNA, 55 bp, Artificial Sequence
  Synthetic polynucleotide
attacgacgttggctgggagagtccgacgttggctgggagagtcctcacaatggc

SEQ ID NO: 8060 - DNA, 55 bp, Artificial Sequence
  Synthetic polynucleotide
cacttctttgctgctggttccatgtgctgctggttccatgatatcatatccttgc

SEQ ID NO: 8061 - DNA, 55 bp, Artificial Sequence
  Synthetic polynucleotide
accgacgacgcccgccttgggggcgaggcggggcgaggcggcccggggggcctcg

SEQ ID NO: 8062 - DNA, 55 bp, Artificial Sequence
  Synthetic polynucleotide
cgggaccgagcgtccgcagcccgcggcccgcggcccgagcagttgacgcggcagg

SEQ ID NO: 8063 - DNA, 55 bp, Artificial Sequence
  Synthetic polynucleotide
gtcgtaatcgctggtgctgaagcctcctgctggtgctgaagcctcctgcggccga

SEQ ID NO: 8064 - DNA, 55 bp, Artificial Sequence
  Synthetic polynucleotide
cttttcctcccaggtggccgtcgaggaccgaggaccgagtcaggcagctgcatga

SEQ ID NO: 8065 - DNA, 55 bp, Artificial Sequence
  Synthetic polynucleotide
caccatggcatagaggtcgatggccccgtctggccccgtctgccagccgctgcag

SEQ ID NO: 8066 - DNA, 55 bp, Artificial Sequence
  Synthetic polynucleotide
gcacaacccatggctgcgctgggctgcgctgggctgcgcgaggctgaggtgggcg

SEQ ID NO: 8067 - DNA, 55 bp, Artificial Sequence
  Synthetic polynucleotide
tgttggtaacgctggtcctgctggtcctgctggtcccgccggtccccgtggtgaa

SEQ ID NO: 8068 - DNA, 55 bp, Artificial Sequence
  Synthetic polynucleotide
gggggtgcggcggaggcgggggtgcggccgaggcgggggtgcggccggcgggcct

SEQ ID NO: 8069 - DNA, 55 bp, Artificial Sequence
  Synthetic polynucleotide
tcatcagctccccccaggaggtgaggttgcaggaggtgaggttgcagtaggtgag

SEQ ID NO: 8070 - DNA, 55 bp, Artificial Sequence
  Synthetic polynucleotide
aggcgggtcgggggcggggctgggctgggctgggctggaaggtgagctcgggaac

SEQ ID NO: 8071 - DNA, 55 bp, Artificial Sequence
  Synthetic polynucleotide
ctgctgctgcgcgcctggccccggggccccggggccccgcggttggtccgggagc

SEQ ID NO: 8072 - DNA, 55 bp, Artificial Sequence
  Synthetic polynucleotide
agcgagcgctgggctgtgggcagtgggcagtggaaactgcagccgctggggctca

SEQ ID NO: 8073 - DNA, 55 bp, Artificial Sequence
  Synthetic polynucleotide
aacagcaccagcaggaccaacaggaccaacaggaccagaaggaccctgtgaaatg

SEQ ID NO: 8074 - DNA, 55 bp, Artificial Sequence
  Synthetic polynucleotide
acaccccacagggtggagggtggaacgtggtggagggtggaacgtgcggctgcgt

SEQ ID NO: 8075 - DNA, 55 bp, Artificial Sequence
  Synthetic polynucleotide
gagggagtgggggaggggctggtccattcccggggctggtccattcccggagctg

SEQ ID NO: 8076 - DNA, 55 bp, Artificial Sequence
  Synthetic polynucleotide
gccaccaagggctgccttcgggccgccttcgggccctggccatgaagttcaagac

SEQ ID NO: 8077 - DNA, 55 bp, Artificial Sequence
  Synthetic polynucleotide
accactccaccttcgtgggcaaggtgtggcgggcaaggtgtggctcacggtgctg

SEQ ID NO: 8078 - DNA, 55 bp, Artificial Sequence
  Synthetic polynucleotide
cggaggaaccgtttcaagtggggcccagcggggcccagcatcccagcagatcctg

SEQ ID NO: 8079 - DNA, 55 bp, Artificial Sequence
  Synthetic polynucleotide
tgctcggccgcaggaggcttcagcaccagcaggaggcttcagcaccagcgattac

SEQ ID NO: 8080 - DNA, 55 bp, Artificial Sequence
  Synthetic polynucleotide
ggaaggaggcgaaggccggccggtcggcgaaggccggccggtcggcgaaggccga

SEQ ID NO: 8081 - DNA, 55 bp, Artificial Sequence
  Synthetic polynucleotide
aggcggcgcagcgcaaaggggcggacgctgagggcggacgctgagggcggccagg

SEQ ID NO: 8082 - DNA, 55 bp, Artificial Sequence
  Synthetic polynucleotide
gagttctgctacgcggtggaggcagggtggaggcagcgtatgtgaccccagtcct

SEQ ID NO: 8083 - DNA, 55 bp, Artificial Sequence
  Synthetic polynucleotide
ccaccgtgccacaggtggcggtgttgtacgtggcggtgttgtacttggcgtgcag

SEQ ID NO: 8084 - DNA, 55 bp, Artificial Sequence
  Synthetic polynucleotide
acgaggaaaactgcggtatgggcggggccagggcggggccagggtgggggcgggg

SEQ ID NO: 8085 - DNA, 55 bp, Artificial Sequence
  Synthetic polynucleotide
ctgggcgccgaggaggagatggaggccgggaggccgggcggccgcggcccgtgct

SEQ ID NO: 8086 - DNA, 55 bp, Artificial Sequence
  Synthetic polynucleotide
catccacacagcagcggacctcgggagcagcggacctcgggggcggcggcgccca

SEQ ID NO: 8087 - DNA, 55 bp, Artificial Sequence
  Synthetic polynucleotide
gcggaatcaaaagggtcgaggtaagggaaaagggtcgaggtaagggaaaagcttc

SEQ ID NO: 8088 - DNA, 55 bp, Artificial Sequence
  Synthetic polynucleotide
acctcgccacacagggtgctcacggccatgcgggtgctcacggccatgcccagga

SEQ ID NO: 8089 - DNA, 55 bp, Artificial Sequence
  Synthetic polynucleotide
tcctttgcctgggggtcttcctttgcctgggggtcttccttctatggaagaactg

SEQ ID NO: 8090 - DNA, 55 bp, Artificial Sequence
  Synthetic polynucleotide
gcaccctcatcacccgcggggagacggtgtggggagacggtgtccaccccactga

SEQ ID NO: 8091 - DNA, 55 bp, Artificial Sequence
  Synthetic polynucleotide
cgacgttggctgggagagtccgacgttggctgggagagtcctcacaatggctcgg

SEQ ID NO: 8092 - DNA, 55 bp, Artificial Sequence
  Synthetic polynucleotide
gagcaggaggaggtgggggctggggcgtgggggctggggcttggggccacagaca

SEQ ID NO: 8093 - DNA, 55 bp, Artificial Sequence
  Synthetic polynucleotide
gcgctgtgaccgcaagatggaggtgggaggtggcgttcatggtgtgtgccatcaa

SEQ ID NO: 8094 - DNA, 55 bp, Artificial Sequence
  Synthetic polynucleotide
cgcaccctcatcacccgcggggagacggtgtggggagacggtgtccaccccactg

SEQ ID NO: 8095 - DNA, 55 bp, Artificial Sequence
  Synthetic polynucleotide
ttgccacagcccgggaaggggcaggggaaggggcaggggaagggtttctcgcctg

SEQ ID NO: 8096 - DNA, 55 bp, Artificial Sequence
  Synthetic polynucleotide
ctccagcccgggtcggcggccccggggcgacggccccggggcgacgtggagagca

SEQ ID NO: 8097 - DNA, 55 bp, Artificial Sequence
  Synthetic polynucleotide
ctaggacctcttgggccaacagcaccagcagggccaacagcaccagcaggaccaa

SEQ ID NO: 8098 - DNA, 55 bp, Artificial Sequence
  Synthetic polynucleotide
gctgcgttgcagctggggctgcgttgcagctggggctgcgggcggcggggctggg

SEQ ID NO: 8099 - DNA, 55 bp, Artificial Sequence
  Synthetic polynucleotide
gctccacctgtagcacaagaggccttaaaaaggccttaaaaaaggaacttgaaac

SEQ ID NO: 8100 - DNA, 55 bp, Artificial Sequence
  Synthetic polynucleotide
gagcatgtccttggggccctgggggaagcctgggggaagccagggggaagccagg

SEQ ID NO: 8101 - DNA, 55 bp, Artificial Sequence
  Synthetic polynucleotide
tggtctcccaggggcagccgggcacgaaggtgggcagccgggcacgaaggtggcc

SEQ ID NO: 8102 - DNA, 55 bp, Artificial Sequence
  Synthetic polynucleotide
tccatgagcctggacatggggcaaccttctcggggcaaccttctcaggccaacac

SEQ ID NO: 8103 - DNA, 55 bp, Artificial Sequence
  Synthetic polynucleotide
tgagccggcctcggctggtgctgcctcggctggtgctgccgcggctggcgctgcc

SEQ ID NO: 8104 - DNA, 55 bp, Artificial Sequence
  Synthetic polynucleotide
gcgcagggtgtagcggagggcgcggggcgcggggccgggcgccgccagcggcgtg

SEQ ID NO: 8105 - DNA, 55 bp, Artificial Sequence
  Synthetic polynucleotide
tgcgccgcccttgccgggttcgcctcccggggggttcgcctcccgggcccccggg

SEQ ID NO: 8106 - DNA, 55 bp, Artificial Sequence
  Synthetic polynucleotide
ataggcatgaagggctgggaggcaagggctgggaggcagggctgggcctggacat

SEQ ID NO: 8107 - DNA, 55 bp, Artificial Sequence
  Synthetic polynucleotide
ctgggaggcccgccggccgcacccccgcctcggccgcacccccgcctccgccgca

SEQ ID NO: 8108 - DNA, 55 bp, Artificial Sequence
  Synthetic polynucleotide
ggtctgctgcagggaggcccggatgctgaagggaggcccggatgctgatggacac

SEQ ID NO: 8109 - DNA, 55 bp, Artificial Sequence
  Synthetic polynucleotide
gcctgcaggctgagcgagcgcaggcggcgcaggcggcgcaggccctgcagcgagc

SEQ ID NO: 8110 - DNA, 55 bp, Artificial Sequence
  Synthetic polynucleotide
cgggggctccgggcagtgctggcggcgtcctggcggcgtcctggctgccctgctg

SEQ ID NO: 8111 - DNA, 55 bp, Artificial Sequence
  Synthetic polynucleotide
ggggtgaactcggcggggaggtgctcggcggggaggtgggcggccagggtcacca

SEQ ID NO: 8112 - DNA, 55 bp, Artificial Sequence
  Synthetic polynucleotide
catgtccttggggccctgggggaagcctgggggaagccagggggaagccaggagt

SEQ ID NO: 8113 - DNA, 55 bp, Artificial Sequence
  Synthetic polynucleotide
tgaggccgccaggcgggtcgggggcgggcgggggcggggctgggctggaaggtga

SEQ ID NO: 8114 - DNA, 55 bp, Artificial Sequence
  Synthetic polynucleotide
ggcgcagggcgggggccgcggcgcgggggcgggggccgcggcgcgggggcggggg

SEQ ID NO: 8115 - DNA, 55 bp, Artificial Sequence
  Synthetic polynucleotide
ggcgcagggtgtagcggagggcgcggggcgcggggccgggcgccgccagcggcgt

SEQ ID NO: 8116 - DNA, 55 bp, Artificial Sequence
  Synthetic polynucleotide
gcacgcagagtggaaggccaggcaggtggaaggccaggcactatggaacaggcta

SEQ ID NO: 8117 - DNA, 20 bp, Artificial Sequence
  Synthetic polynucleotide
gctggtgctgttggccctgc

SEQ ID NO: 8118 - DNA, 20 bp, Artificial Sequence
  Synthetic polynucleotide
ggcgggggtgcggccggggc

SEQ ID NO: 8119 - DNA, 20 bp, Artificial Sequence
  Synthetic polynucleotide
aggcgggggtgcggccgagg

SEQ ID NO: 8120 - DNA, 20 bp, Artificial Sequence
  Synthetic polynucleotide
ctctgcggcaagtccctctg

SEQ ID NO: 8121 - DNA, 20 bp, Artificial Sequence
  Synthetic polynucleotide
ccaggtgccattttggggcc

SEQ ID NO: 8122 - DNA, 20 bp, Artificial Sequence
  Synthetic polynucleotide
catggccgtgagcacccgca

SEQ ID NO: 8123 - DNA, 20 bp, Artificial Sequence
  Synthetic polynucleotide
gtggccctgcccggcgcgtg

SEQ ID NO: 8124 - DNA, 20 bp, Artificial Sequence
  Synthetic polynucleotide
cggcggcggggagccccggg

SEQ ID NO: 8125 - DNA, 20 bp, Artificial Sequence
  Synthetic polynucleotide
ctgggtgtggctcccctggc

SEQ ID NO: 8126 - DNA, 20 bp, Artificial Sequence
  Synthetic polynucleotide
ctggtccggcaggtgtcgtc

SEQ ID NO: 8127 - DNA, 20 bp, Artificial Sequence
  Synthetic polynucleotide
cggccagccagccccggtac

SEQ ID NO: 8128 - DNA, 20 bp, Artificial Sequence
  Synthetic polynucleotide
ctcggcggggaggtgctcgg

SEQ ID NO: 8129 - DNA, 20 bp, Artificial Sequence
  Synthetic polynucleotide
tgaaggcatccttgctctga

SEQ ID NO: 8130 - DNA, 20 bp, Artificial Sequence
  Synthetic polynucleotide
gcgtggtaaacttttgggcg

SEQ ID NO: 8131 - DNA, 20 bp, Artificial Sequence
  Synthetic polynucleotide
tccggcaggtgtcgtccggc

SEQ ID NO: 8132 - DNA, 20 bp, Artificial Sequence
  Synthetic polynucleotide
aaccggggcactgcagctac

SEQ ID NO: 8133 - DNA, 20 bp, Artificial Sequence
  Synthetic polynucleotide
gggcaaggaggtggggttgt

SEQ ID NO: 8134 - DNA, 20 bp, Artificial Sequence
  Synthetic polynucleotide
catctggacccttttccatc

SEQ ID NO: 8135 - DNA, 20 bp, Artificial Sequence
  Synthetic polynucleotide
agagtgttcatctgggaatc

SEQ ID NO: 8136 - DNA, 20 bp, Artificial Sequence
  Synthetic polynucleotide
ttggggtgctccgcctggct

SEQ ID NO: 8137 - DNA, 20 bp, Artificial Sequence
  Synthetic polynucleotide
agggggcggaggcctggcaa

SEQ ID NO: 8138 - DNA, 20 bp, Artificial Sequence
  Synthetic polynucleotide
gaacctgggcaagctggacc

SEQ ID NO: 8139 - DNA, 20 bp, Artificial Sequence
  Synthetic polynucleotide
catccgttggacacctccgt

SEQ ID NO: 8140 - DNA, 20 bp, Artificial Sequence
  Synthetic polynucleotide
tggctgggagagtccgacgt

SEQ ID NO: 8141 - DNA, 20 bp, Artificial Sequence
  Synthetic polynucleotide
cttctcatgtctccggtctc

SEQ ID NO: 8142 - DNA, 20 bp, Artificial Sequence
  Synthetic polynucleotide
tgtgccacatggctcccaca

SEQ ID NO: 8143 - DNA, 20 bp, Artificial Sequence
  Synthetic polynucleotide
gaggcccggatgctgaaggg

SEQ ID NO: 8144 - DNA, 20 bp, Artificial Sequence
  Synthetic polynucleotide
aaggttggctgtaccaaggt

SEQ ID NO: 8145 - DNA, 20 bp, Artificial Sequence
  Synthetic polynucleotide
tcggcggggaggtgctcggc

SEQ ID NO: 8146 - DNA, 20 bp, Artificial Sequence
  Synthetic polynucleotide
ttggtatgttatcgttggct

SEQ ID NO: 8147 - DNA, 20 bp, Artificial Sequence
  Synthetic polynucleotide
ctggtggaatggggccctgg

SEQ ID NO: 8148 - DNA, 20 bp, Artificial Sequence
  Synthetic polynucleotide
ccctggagcgcaagttcccc

SEQ ID NO: 8149 - DNA, 20 bp, Artificial Sequence
  Synthetic polynucleotide
tactgtcggatttctgctgt

SEQ ID NO: 8150 - DNA, 20 bp, Artificial Sequence
  Synthetic polynucleotide
cagctggagtggatgccagc

SEQ ID NO: 8151 - DNA, 20 bp, Artificial Sequence
  Synthetic polynucleotide
gtcggaggagacgtagaggt

SEQ ID NO: 8152 - DNA, 20 bp, Artificial Sequence
  Synthetic polynucleotide
gaaaagggtccagatggaaa

SEQ ID NO: 8153 - DNA, 20 bp, Artificial Sequence
  Synthetic polynucleotide
aaagggccttcctgaggaaa

SEQ ID NO: 8154 - DNA, 20 bp, Artificial Sequence
  Synthetic polynucleotide
ctgctggttccatgtgctgc

SEQ ID NO: 8155 - DNA, 20 bp, Artificial Sequence
  Synthetic polynucleotide
tggagggtggaacgtggtgg

SEQ ID NO: 8156 - DNA, 20 bp, Artificial Sequence
  Synthetic polynucleotide
cccgaggtccgctgctcccg

SEQ ID NO: 8157 - DNA, 20 bp, Artificial Sequence
  Synthetic polynucleotide
aatggcacctggccccaaaa

SEQ ID NO: 8158 - DNA, 20 bp, Artificial Sequence
  Synthetic polynucleotide
ttgcttcaggcccttgcttc

SEQ ID NO: 8159 - DNA, 20 bp, Artificial Sequence
  Synthetic polynucleotide
gagcagcggcagaaaaacag

SEQ ID NO: 8160 - DNA, 20 bp, Artificial Sequence
  Synthetic polynucleotide
ctgcagaaggtgactgcaga

SEQ ID NO: 8161 - DNA, 20 bp, Artificial Sequence
  Synthetic polynucleotide
ggtcaactggtagacacaac

SEQ ID NO: 8162 - DNA, 20 bp, Artificial Sequence
  Synthetic polynucleotide
caaggacaaatctgactgca

SEQ ID NO: 8163 - DNA, 20 bp, Artificial Sequence
  Synthetic polynucleotide
agagtggaaggccaggcagg

SEQ ID NO: 8164 - DNA, 20 bp, Artificial Sequence
  Synthetic polynucleotide
agggcacatctgggtgcatc

SEQ ID NO: 8165 - DNA, 20 bp, Artificial Sequence
  Synthetic polynucleotide
tgggagagtccgacgttggc

SEQ ID NO: 8166 - DNA, 20 bp, Artificial Sequence
  Synthetic polynucleotide
ttgtaaatgggggtgtaaat

SEQ ID NO: 8167 - DNA, 20 bp, Artificial Sequence
  Synthetic polynucleotide
ctgctgccggcactggacac

SEQ ID NO: 8168 - DNA, 20 bp, Artificial Sequence
  Synthetic polynucleotide
tacctcacggtgggccttca

SEQ ID NO: 8169 - DNA, 20 bp, Artificial Sequence
  Synthetic polynucleotide
tctcatggatgagacgctca

SEQ ID NO: 8170 - DNA, 20 bp, Artificial Sequence
  Synthetic polynucleotide
aagggggcggaggcctggca

SEQ ID NO: 8171 - DNA, 20 bp, Artificial Sequence
  Synthetic polynucleotide
agctggacttgctcaggagc

SEQ ID NO: 8172 - DNA, 20 bp, Artificial Sequence
  Synthetic polynucleotide
tattgatggacatttattga

SEQ ID NO: 8173 - DNA, 20 bp, Artificial Sequence
  Synthetic polynucleotide
ggcccggaggctgggcggcc

SEQ ID NO: 8174 - DNA, 20 bp, Artificial Sequence
  Synthetic polynucleotide
gcgaagatggctcggaggct

SEQ ID NO: 8175 - DNA, 20 bp, Artificial Sequence
  Synthetic polynucleotide
gcggaaatgcttgatttcag

SEQ ID NO: 8176 - DNA, 20 bp, Artificial Sequence
  Synthetic polynucleotide
acacactccctggaagtccc

SEQ ID NO: 8177 - DNA, 20 bp, Artificial Sequence
  Synthetic polynucleotide
gcgggggtgcggccgaggcg

SEQ ID NO: 8178 - DNA, 20 bp, Artificial Sequence
  Synthetic polynucleotide
cgtgctggcgctcttcgtgc

SEQ ID NO: 8179 - DNA, 20 bp, Artificial Sequence
  Synthetic polynucleotide
ccacacgggccttgacgtac

SEQ ID NO: 8180 - DNA, 20 bp, Artificial Sequence
  Synthetic polynucleotide
ggcagcggcggcagctgcag

SEQ ID NO: 8181 - DNA, 20 bp, Artificial Sequence
  Synthetic polynucleotide
gaggcttcagcaccagcagg

SEQ ID NO: 8182 - DNA, 20 bp, Artificial Sequence
  Synthetic polynucleotide
gcggagcaccccaagccagg

SEQ ID NO: 8183 - DNA, 20 bp, Artificial Sequence
  Synthetic polynucleotide
gagtgttcatctgggaatct

SEQ ID NO: 8184 - DNA, 20 bp, Artificial Sequence
  Synthetic polynucleotide
cggcggggaggtgctcggcg

SEQ ID NO: 8185 - DNA, 20 bp, Artificial Sequence
  Synthetic polynucleotide
cagggcagcgatgcactcac

SEQ ID NO: 8186 - DNA, 20 bp, Artificial Sequence
  Synthetic polynucleotide
tgcttggagcagggggtgct

SEQ ID NO: 8187 - DNA, 20 bp, Artificial Sequence
  Synthetic polynucleotide
cggggcggtttggggcggtt

SEQ ID NO: 8188 - DNA, 20 bp, Artificial Sequence
  Synthetic polynucleotide
agacgcaggaagaaagacgc

SEQ ID NO: 8189 - DNA, 20 bp, Artificial Sequence
  Synthetic polynucleotide
ttgaaggccatcacgtatga

SEQ ID NO: 8190 - DNA, 20 bp, Artificial Sequence
  Synthetic polynucleotide
caggccagtgacaatgagtc

SEQ ID NO: 8191 - DNA, 20 bp, Artificial Sequence
  Synthetic polynucleotide
cacctggatgagacggtccc

SEQ ID NO: 8192 - DNA, 20 bp, Artificial Sequence
  Synthetic polynucleotide
ggcggtgcagccgaaggagg

SEQ ID NO: 8193 - DNA, 20 bp, Artificial Sequence
  Synthetic polynucleotide
tccaaagatggtcaaggtca

SEQ ID NO: 8194 - DNA, 20 bp, Artificial Sequence
  Synthetic polynucleotide
tgggagcagcaggtgtcgat

SEQ ID NO: 8195 - DNA, 20 bp, Artificial Sequence
  Synthetic polynucleotide
tggcctgcacagactggtta

SEQ ID NO: 8196 - DNA, 20 bp, Artificial Sequence
  Synthetic polynucleotide
cgggaggcgaaccccccggg

SEQ ID NO: 8197 - DNA, 20 bp, Artificial Sequence
  Synthetic polynucleotide
acatctactcgctggtgagc

SEQ ID NO: 8198 - DNA, 20 bp, Artificial Sequence
  Synthetic polynucleotide
tgcggtccgggactgcggtc

SEQ ID NO: 8199 - DNA, 20 bp, Artificial Sequence
  Synthetic polynucleotide
actctgcggcaagtcctctg

SEQ ID NO: 8200 - DNA, 20 bp, Artificial Sequence
  Synthetic polynucleotide
tgactaatctggatcctatc

SEQ ID NO: 8201 - DNA, 20 bp, Artificial Sequence
  Synthetic polynucleotide
aacctgggcaagctggacct

SEQ ID NO: 8202 - DNA, 20 bp, Artificial Sequence
  Synthetic polynucleotide
cgatcaccgtgcggcacgtg

SEQ ID NO: 8203 - DNA, 20 bp, Artificial Sequence
  Synthetic polynucleotide
cgctgaaggggaaggctcga

SEQ ID NO: 8204 - DNA, 20 bp, Artificial Sequence
  Synthetic polynucleotide
tttgatgaggaggaaggatg

SEQ ID NO: 8205 - DNA, 20 bp, Artificial Sequence
  Synthetic polynucleotide
ttaggtgggcttagatttgt

SEQ ID NO: 8206 - DNA, 20 bp, Artificial Sequence
  Synthetic polynucleotide
gctgaaggggaaggctcgaa

SEQ ID NO: 8207 - DNA, 20 bp, Artificial Sequence
  Synthetic polynucleotide
gcaggacgcccgcggcgagc

SEQ ID NO: 8208 - DNA, 20 bp, Artificial Sequence
  Synthetic polynucleotide
gttgtaaatgggggtgtaaa

SEQ ID NO: 8209 - DNA, 20 bp, Artificial Sequence
  Synthetic polynucleotide
ggtcacgctacctggcgacc

SEQ ID NO: 8210 - DNA, 20 bp, Artificial Sequence
  Synthetic polynucleotide
gcaaggatgccttcagagca

SEQ ID NO: 8211 - DNA, 20 bp, Artificial Sequence
  Synthetic polynucleotide
atgatggctggcatgatggc

SEQ ID NO: 8212 - DNA, 20 bp, Artificial Sequence
  Synthetic polynucleotide
cggcgggctcgggctgcggc

SEQ ID NO: 8213 - DNA, 20 bp, Artificial Sequence
  Synthetic polynucleotide
tagtcacatgattggcagat

SEQ ID NO: 8214 - DNA, 20 bp, Artificial Sequence
  Synthetic polynucleotide
ttccgggctaaagaagcccc

SEQ ID NO: 8215 - DNA, 20 bp, Artificial Sequence
  Synthetic polynucleotide
ctttgcttccagggacttcc

SEQ ID NO: 8216 - DNA, 20 bp, Artificial Sequence
  Synthetic polynucleotide
ggagccttcgatgcggaatg

SEQ ID NO: 8217 - DNA, 20 bp, Artificial Sequence
  Synthetic polynucleotide
agtacactatcctggaatcc

SEQ ID NO: 8218 - DNA, 20 bp, Artificial Sequence
  Synthetic polynucleotide
gaatggaccagccccgggaa

SEQ ID NO: 8219 - DNA, 20 bp, Artificial Sequence
  Synthetic polynucleotide
ttctgaaggcaggtgaaggc

SEQ ID NO: 8220 - DNA, 20 bp, Artificial Sequence
  Synthetic polynucleotide
aggaggactcactggttcac

SEQ ID NO: 8221 - DNA, 20 bp, Artificial Sequence
  Synthetic polynucleotide
tctgaaggcaggtgcaaggc

SEQ ID NO: 8222 - DNA, 20 bp, Artificial Sequence
  Synthetic polynucleotide
gggtggagggtggaacgtgg

SEQ ID NO: 8223 - DNA, 20 bp, Artificial Sequence
  Synthetic polynucleotide
agcaaggtgcaggtgggtgc

SEQ ID NO: 8224 - DNA, 20 bp, Artificial Sequence
  Synthetic polynucleotide
gagtccagtgaaatggaaaa

SEQ ID NO: 8225 - DNA, 20 bp, Artificial Sequence
  Synthetic polynucleotide
cgtggccgacctgtctatcg

SEQ ID NO: 8226 - DNA, 20 bp, Artificial Sequence
  Synthetic polynucleotide
aaaggttctgctagtgataa

SEQ ID NO: 8227 - DNA, 20 bp, Artificial Sequence
  Synthetic polynucleotide
agtcctgctgatgctagcta

SEQ ID NO: 8228 - DNA, 20 bp, Artificial Sequence
  Synthetic polynucleotide
ggacagactctggatgactc

SEQ ID NO: 8229 - DNA, 20 bp, Artificial Sequence
  Synthetic polynucleotide
acgcatgtctcgcggtaccg

SEQ ID NO: 8230 - DNA, 20 bp, Artificial Sequence
  Synthetic polynucleotide
aggctgtgcgggaaatgtgc

SEQ ID NO: 8231 - DNA, 20 bp, Artificial Sequence
  Synthetic polynucleotide
gtagatcggctgctgcagat

SEQ ID NO: 8232 - DNA, 20 bp, Artificial Sequence
  Synthetic polynucleotide
cggccctggacgtgggtacg

SEQ ID NO: 8233 - DNA, 20 bp, Artificial Sequence
  Synthetic polynucleotide
ttcaggatgagactggagac

SEQ ID NO: 8234 - DNA, 20 bp, Artificial Sequence
  Synthetic polynucleotide
tcgttcctccgagctggagc

SEQ ID NO: 8235 - DNA, 20 bp, Artificial Sequence
  Synthetic polynucleotide
aggtgggagaaggtgagaga

SEQ ID NO: 8236 - DNA, 20 bp, Artificial Sequence
  Synthetic polynucleotide
tcagtggatcaagtttacag

SEQ ID NO: 8237 - DNA, 20 bp, Artificial Sequence
  Synthetic polynucleotide
tcatcagtggggcgctggag

SEQ ID NO: 8238 - DNA, 20 bp, Artificial Sequence
  Synthetic polynucleotide
ctcatgataaggatgatata

SEQ ID NO: 8239 - DNA, 20 bp, Artificial Sequence
  Synthetic polynucleotide
taggtccaggtgctgggtcc

SEQ ID NO: 8240 - DNA, 20 bp, Artificial Sequence
  Synthetic polynucleotide
tggggtgctccgcctggctt

SEQ ID NO: 8241 - DNA, 20 bp, Artificial Sequence
  Synthetic polynucleotide
gggcatggctctctggggca

SEQ ID NO: 8242 - DNA, 20 bp, Artificial Sequence
  Synthetic polynucleotide
gcagcggacctcgggagcag

SEQ ID NO: 8243 - DNA, 20 bp, Artificial Sequence
  Synthetic polynucleotide
agcggtgcatgggctgcgca

SEQ ID NO: 8244 - DNA, 20 bp, Artificial Sequence
  Synthetic polynucleotide
gactggatcacagggatcac

SEQ ID NO: 8245 - DNA, 20 bp, Artificial Sequence
  Synthetic polynucleotide
ttgtgccacatggctccaca

SEQ ID NO: 8246 - DNA, 20 bp, Artificial Sequence
  Synthetic polynucleotide
aaggtgcaggtgggtgcagg

SEQ ID NO: 8247 - DNA, 20 bp, Artificial Sequence
  Synthetic polynucleotide
tatttgttcttacaggcaac

SEQ ID NO: 8248 - DNA, 20 bp, Artificial Sequence
  Synthetic polynucleotide
ggtggcggtgttgtacgtgg

SEQ ID NO: 8249 - DNA, 20 bp, Artificial Sequence
  Synthetic polynucleotide
cctgcgaacatacctagcta

SEQ ID NO: 8250 - DNA, 20 bp, Artificial Sequence
  Synthetic polynucleotide
atggtgctgctgccccgaaa

SEQ ID NO: 8251 - DNA, 20 bp, Artificial Sequence
  Synthetic polynucleotide
tcaccagtgtgggcttcgtg

SEQ ID NO: 8252 - DNA, 20 bp, Artificial Sequence
  Synthetic polynucleotide
tgggccggggcggtttgggg

SEQ ID NO: 8253 - DNA, 20 bp, Artificial Sequence
  Synthetic polynucleotide
caacatggcagcagccaaca

SEQ ID NO: 8254 - DNA, 20 bp, Artificial Sequence
  Synthetic polynucleotide
cgatgacggcattggcgcat

SEQ ID NO: 8255 - DNA, 20 bp, Artificial Sequence
  Synthetic polynucleotide
gggcggcggccggaagggcg

SEQ ID NO: 8256 - DNA, 20 bp, Artificial Sequence
  Synthetic polynucleotide
ctcacggtgggccttcacgg

SEQ ID NO: 8257 - DNA, 20 bp, Artificial Sequence
  Synthetic polynucleotide
gactttaggcagaggctggc

SEQ ID NO: 8258 - DNA, 20 bp, Artificial Sequence
  Synthetic polynucleotide
ccaggggacccaggagaccc

SEQ ID NO: 8259 - DNA, 20 bp, Artificial Sequence
  Synthetic polynucleotide
gcagctgacagagggttaga

SEQ ID NO: 8260 - DNA, 20 bp, Artificial Sequence
  Synthetic polynucleotide
aggtaacccaggagaaagtc

SEQ ID NO: 8261 - DNA, 20 bp, Artificial Sequence
  Synthetic polynucleotide
cgggctcggactacggacta

SEQ ID NO: 8262 - DNA, 20 bp, Artificial Sequence
  Synthetic polynucleotide
gaggtccgctgctgcccccg

SEQ ID NO: 8263 - DNA, 20 bp, Artificial Sequence
  Synthetic polynucleotide
cagcaggggaggcccccagc

SEQ ID NO: 8264 - DNA, 20 bp, Artificial Sequence
  Synthetic polynucleotide
aggcggtcggcgggcgcggt

SEQ ID NO: 8265 - DNA, 20 bp, Artificial Sequence
  Synthetic polynucleotide
catgaccttcctgcagccag

SEQ ID NO: 8266 - DNA, 20 bp, Artificial Sequence
  Synthetic polynucleotide
tgctctctgtgtagtggtag

SEQ ID NO: 8267 - DNA, 20 bp, Artificial Sequence
  Synthetic polynucleotide
cggcgcggtggcgcgggagg

SEQ ID NO: 8268 - DNA, 20 bp, Artificial Sequence
  Synthetic polynucleotide
gacggcatgctgctggctgc

SEQ ID NO: 8269 - DNA, 20 bp, Artificial Sequence
  Synthetic polynucleotide
acgccggcatctcaggccgc

SEQ ID NO: 8270 - DNA, 20 bp, Artificial Sequence
  Synthetic polynucleotide
ccacactggcaagtccacac

SEQ ID NO: 8271 - DNA, 20 bp, Artificial Sequence
  Synthetic polynucleotide
aagaataggcacaatagaat

SEQ ID NO: 8272 - DNA, 20 bp, Artificial Sequence
  Synthetic polynucleotide
aagccgcagacgtcggccgt

SEQ ID NO: 8273 - DNA, 20 bp, Artificial Sequence
  Synthetic polynucleotide
aagactgctcagggctactc

SEQ ID NO: 8274 - DNA, 20 bp, Artificial Sequence
  Synthetic polynucleotide
cgatggaggggccggactgg

SEQ ID NO: 8275 - DNA, 20 bp, Artificial Sequence
  Synthetic polynucleotide
cgcggtgcggtccgggactg

SEQ ID NO: 8276 - DNA, 20 bp, Artificial Sequence
  Synthetic polynucleotide
cctggtgctgtaggtgctca

SEQ ID NO: 8277 - DNA, 20 bp, Artificial Sequence
  Synthetic polynucleotide
cgagtccgactccggtactc

SEQ ID NO: 8278 - DNA, 20 bp, Artificial Sequence
  Synthetic polynucleotide
ctcaggtgccagcacggctc

SEQ ID NO: 8279 - DNA, 20 bp, Artificial Sequence
  Synthetic polynucleotide
gagcttgctcctttctttct

SEQ ID NO: 8280 - DNA, 20 bp, Artificial Sequence
  Synthetic polynucleotide
cccccaggaggtgaggttgc

SEQ ID NO: 8281 - DNA, 20 bp, Artificial Sequence
  Synthetic polynucleotide
gcagggtcagcctggaggcc

SEQ ID NO: 8282 - DNA, 20 bp, Artificial Sequence
  Synthetic polynucleotide
gaactcggcggggaggtgct

SEQ ID NO: 8283 - DNA, 20 bp, Artificial Sequence
  Synthetic polynucleotide
agacatcatgtgcggggatg

SEQ ID NO: 8284 - DNA, 20 bp, Artificial Sequence
  Synthetic polynucleotide
ggaccgggagcaccaggacc

SEQ ID NO: 8285 - DNA, 20 bp, Artificial Sequence
  Synthetic polynucleotide
ttgtagatggccatggccca

SEQ ID NO: 8286 - DNA, 20 bp, Artificial Sequence
  Synthetic polynucleotide
cgctacctggcgcggctccc

SEQ ID NO: 8287 - DNA, 20 bp, Artificial Sequence
  Synthetic polynucleotide
agacggctaggtgctccaga

SEQ ID NO: 8288 - DNA, 20 bp, Artificial Sequence
  Synthetic polynucleotide
atgagctcactgttctgttc

SEQ ID NO: 8289 - DNA, 20 bp, Artificial Sequence
  Synthetic polynucleotide
tctgaagaacagaacagaac

SEQ ID NO: 8290 - DNA, 20 bp, Artificial Sequence
  Synthetic polynucleotide
atgtgatagaaaagctgggc

SEQ ID NO: 8291 - DNA, 20 bp, Artificial Sequence
  Synthetic polynucleotide
tggaaggccaggcaggtgga

SEQ ID NO: 8292 - DNA, 20 bp, Artificial Sequence
  Synthetic polynucleotide
tcacggctcagacggcttca

SEQ ID NO: 8293 - DNA, 20 bp, Artificial Sequence
  Synthetic polynucleotide
atcatggaaccagcagcaca

SEQ ID NO: 8294 - DNA, 20 bp, Artificial Sequence
  Synthetic polynucleotide
atgagggacactatatgatg

SEQ ID NO: 8295 - DNA, 20 bp, Artificial Sequence
  Synthetic polynucleotide
aagggacatagaaaatcaaa

SEQ ID NO: 8296 - DNA, 20 bp, Artificial Sequence
  Synthetic polynucleotide
aagtacgtggacaagctacg

SEQ ID NO: 8297 - DNA, 20 bp, Artificial Sequence
  Synthetic polynucleotide
gcggcaggtgcggctgcagc

SEQ ID NO: 8298 - DNA, 20 bp, Artificial Sequence
  Synthetic polynucleotide
gaaagggccttcctgaggaa

SEQ ID NO: 8299 - DNA, 20 bp, Artificial Sequence
  Synthetic polynucleotide
acagggtgctcacggccatg

SEQ ID NO: 8300 - DNA, 20 bp, Artificial Sequence
  Synthetic polynucleotide
aagggctgggaggcaagggc

SEQ ID NO: 8301 - DNA, 20 bp, Artificial Sequence
  Synthetic polynucleotide
cctttggcacagcggcacag

SEQ ID NO: 8302 - DNA, 20 bp, Artificial Sequence
  Synthetic polynucleotide
ttgttgcagatacatctatc

SEQ ID NO: 8303 - DNA, 20 bp, Artificial Sequence
  Synthetic polynucleotide
gtgcgaggtcggcatgaggt

SEQ ID NO: 8304 - DNA, 20 bp, Artificial Sequence
  Synthetic polynucleotide
aggtgcggctgcagcaggtg

SEQ ID NO: 8305 - DNA, 20 bp, Artificial Sequence
  Synthetic polynucleotide
gcggcgggctcgggctgcgg

SEQ ID NO: 8306 - DNA, 20 bp, Artificial Sequence
  Synthetic polynucleotide
cgaatgctataatgagtagt

SEQ ID NO: 8307 - DNA, 20 bp, Artificial Sequence
  Synthetic polynucleotide
ctgtagtcgtgggcagtcgt

SEQ ID NO: 8308 - DNA, 20 bp, Artificial Sequence
  Synthetic polynucleotide
aggcgggggtgcggccgggg

SEQ ID NO: 8309 - DNA, 20 bp, Artificial Sequence
  Synthetic polynucleotide
tgaagacaaaaggaggatca

SEQ ID NO: 8310 - DNA, 20 bp, Artificial Sequence
  Synthetic polynucleotide
actggatcacagggatcaca

SEQ ID NO: 8311 - DNA, 20 bp, Artificial Sequence
  Synthetic polynucleotide
ttggcagtggtggcatgagg

SEQ ID NO: 8312 - DNA, 20 bp, Artificial Sequence
  Synthetic polynucleotide
aggtgggggctggggcgtgg

SEQ ID NO: 8313 - DNA, 20 bp, Artificial Sequence
  Synthetic polynucleotide
tatgacccaggaagccgagc

SEQ ID NO: 8314 - DNA, 20 bp, Artificial Sequence
  Synthetic polynucleotide
aaacgggtcgccatcgacaa

SEQ ID NO: 8315 - DNA, 20 bp, Artificial Sequence
  Synthetic polynucleotide
attaggtgggcttagatttg

SEQ ID NO: 8316 - DNA, 20 bp, Artificial Sequence
  Synthetic polynucleotide
agactgctcagggctactca

SEQ ID NO: 8317 - DNA, 20 bp, Artificial Sequence
  Synthetic polynucleotide
caccagtgtgggcttcgtgt

SEQ ID NO: 8318 - DNA, 20 bp, Artificial Sequence
  Synthetic polynucleotide
gcctcggcctctcggcctct

SEQ ID NO: 8319 - DNA, 20 bp, Artificial Sequence
  Synthetic polynucleotide
acgcggtggaggcagggtgg

SEQ ID NO: 8320 - DNA, 20 bp, Artificial Sequence
  Synthetic polynucleotide
gcatctacaactggggcaac

SEQ ID NO: 8321 - DNA, 20 bp, Artificial Sequence
  Synthetic polynucleotide
atcagaaggggtaatccaga

SEQ ID NO: 8322 - DNA, 20 bp, Artificial Sequence
  Synthetic polynucleotide
tcgaactcccgcaccagacc

SEQ ID NO: 8323 - DNA, 20 bp, Artificial Sequence
  Synthetic polynucleotide
tcaaaagacaaggttactta

SEQ ID NO: 8324 - DNA, 20 bp, Artificial Sequence
  Synthetic polynucleotide
gtgcggccagtggaagaccg

SEQ ID NO: 8325 - DNA, 20 bp, Artificial Sequence
  Synthetic polynucleotide
gctggatattcgggatattc

SEQ ID NO: 8326 - DNA, 20 bp, Artificial Sequence
  Synthetic polynucleotide
gacggtgaagacggttaaga

SEQ ID NO: 8327 - DNA, 20 bp, Artificial Sequence
  Synthetic polynucleotide
gcaggagactactggactac

SEQ ID NO: 8328 - DNA, 20 bp, Artificial Sequence
  Synthetic polynucleotide
gacatcatgtgcggggatgc

SEQ ID NO: 8329 - DNA, 20 bp, Artificial Sequence
  Synthetic polynucleotide
tgggcaaggtgtggcgggca

SEQ ID NO: 8330 - DNA, 20 bp, Artificial Sequence
  Synthetic polynucleotide
agcatctggaacaacagaac

SEQ ID NO: 8331 - DNA, 20 bp, Artificial Sequence
  Synthetic polynucleotide
cagatggcctccaggcctcc

SEQ ID NO: 8332 - DNA, 20 bp, Artificial Sequence
  Synthetic polynucleotide
cggcgggcgcagccggtcgg

SEQ ID NO: 8333 - DNA, 20 bp, Artificial Sequence
  Synthetic polynucleotide
ccggggcactgcagctaccg

SEQ ID NO: 8334 - DNA, 20 bp, Artificial Sequence
  Synthetic polynucleotide
tgtaaatgggggtgtaaatg

SEQ ID NO: 8335 - DNA, 20 bp, Artificial Sequence
  Synthetic polynucleotide
aacgggtcgccatcgacaac

SEQ ID NO: 8336 - DNA, 20 bp, Artificial Sequence
  Synthetic polynucleotide
ggcggagctgctggagctgc

SEQ ID NO: 8337 - DNA, 20 bp, Artificial Sequence
  Synthetic polynucleotide
cgggatgaagaaggcgaaga

SEQ ID NO: 8338 - DNA, 20 bp, Artificial Sequence
  Synthetic polynucleotide
aagggtcgaggtaagggaaa

SEQ ID NO: 8339 - DNA, 20 bp, Artificial Sequence
  Synthetic polynucleotide
acagggctcgtccaactaac

SEQ ID NO: 8340 - DNA, 20 bp, Artificial Sequence
  Synthetic polynucleotide
cagatggccagctggccagc

SEQ ID NO: 8341 - DNA, 20 bp, Artificial Sequence
  Synthetic polynucleotide
cagggtgctcacggccatgc

SEQ ID NO: 8342 - DNA, 20 bp, Artificial Sequence
  Synthetic polynucleotide
aggaccgggagcaccaggac

SEQ ID NO: 8343 - DNA, 20 bp, Artificial Sequence
  Synthetic polynucleotide
tcaagttcttaggtattctt

SEQ ID NO: 8344 - DNA, 20 bp, Artificial Sequence
  Synthetic polynucleotide
cctgttctgaaggcaggtga

SEQ ID NO: 8345 - DNA, 20 bp, Artificial Sequence
  Synthetic polynucleotide
cgcgaggctgggccgtcgcg

SEQ ID NO: 8346 - DNA, 20 bp, Artificial Sequence
  Synthetic polynucleotide
tcgtaatcgctggtaatcgc

SEQ ID NO: 8347 - DNA, 20 bp, Artificial Sequence
  Synthetic polynucleotide
agagctcctcggacgctcct

SEQ ID NO: 8348 - DNA, 20 bp, Artificial Sequence
  Synthetic polynucleotide
actccccggctttcggcttt

SEQ ID NO: 8349 - DNA, 20 bp, Artificial Sequence
  Synthetic polynucleotide
gacaggatggtgaacaggga

SEQ ID NO: 8350 - DNA, 20 bp, Artificial Sequence
  Synthetic polynucleotide
cgtggtctcggtcattggcg

SEQ ID NO: 8351 - DNA, 20 bp, Artificial Sequence
  Synthetic polynucleotide
tgctggcacctgagccgtgc

SEQ ID NO: 8352 - DNA, 20 bp, Artificial Sequence
  Synthetic polynucleotide
ctcaactccggcatcggcat

SEQ ID NO: 8353 - DNA, 20 bp, Artificial Sequence
  Synthetic polynucleotide
cgcgggcgtcctgctcgccg

SEQ ID NO: 8354 - DNA, 20 bp, Artificial Sequence
  Synthetic polynucleotide
aattcccagcaacaggcaac

SEQ ID NO: 8355 - DNA, 20 bp, Artificial Sequence
  Synthetic polynucleotide
atggaggggccggactggag

SEQ ID NO: 8356 - DNA, 20 bp, Artificial Sequence
  Synthetic polynucleotide
cagcagaccagggccccacc

SEQ ID NO: 8357 - DNA, 20 bp, Artificial Sequence
  Synthetic polynucleotide
gcgggcgtcctgctcgccgc

SEQ ID NO: 8358 - DNA, 20 bp, Artificial Sequence
  Synthetic polynucleotide
ccctgctgctggccagctgc

SEQ ID NO: 8359 - DNA, 20 bp, Artificial Sequence
  Synthetic polynucleotide
gctgaacattggctgaacat

SEQ ID NO: 8360 - DNA, 20 bp, Artificial Sequence
  Synthetic polynucleotide
atgaagcccacagggactca

SEQ ID NO: 8361 - DNA, 20 bp, Artificial Sequence
  Synthetic polynucleotide
tagagtgtcccatctgcatc

SEQ ID NO: 8362 - DNA, 20 bp, Artificial Sequence
  Synthetic polynucleotide
gattcactttcttcctgcct

SEQ ID NO: 8363 - DNA, 20 bp, Artificial Sequence
  Synthetic polynucleotide
attttatgggctaggtcggt

SEQ ID NO: 8364 - DNA, 20 bp, Artificial Sequence
  Synthetic polynucleotide
cctattattgggaatgggaa

SEQ ID NO: 8365 - DNA, 20 bp, Artificial Sequence
  Synthetic polynucleotide
gctgtagtcgtgggcagtcg

SEQ ID NO: 8366 - DNA, 20 bp, Artificial Sequence
  Synthetic polynucleotide
aggacaaatctgacactgca

SEQ ID NO: 8367 - DNA, 20 bp, Artificial Sequence
  Synthetic polynucleotide
caataaaagctgaggtgctg

SEQ ID NO: 8368 - DNA, 20 bp, Artificial Sequence
  Synthetic polynucleotide
ttgcaggggaagaacagaac

SEQ ID NO: 8369 - DNA, 20 bp, Artificial Sequence
  Synthetic polynucleotide
agcacagtagaactaagtaa

SEQ ID NO: 8370 - DNA, 20 bp, Artificial Sequence
  Synthetic polynucleotide
atggctgtggagtcctgcct

SEQ ID NO: 8371 - DNA, 20 bp, Artificial Sequence
  Synthetic polynucleotide
gcaccaggaactcggcttct

SEQ ID NO: 8372 - DNA, 20 bp, Artificial Sequence
  Synthetic polynucleotide
acagggggactccgggactc

SEQ ID NO: 8373 - DNA, 20 bp, Artificial Sequence
  Synthetic polynucleotide
ccaagctggcactggtgagc

SEQ ID NO: 8374 - DNA, 20 bp, Artificial Sequence
  Synthetic polynucleotide
catgaagggctgggaggcaa

SEQ ID NO: 8375 - DNA, 20 bp, Artificial Sequence
  Synthetic polynucleotide
tacgcttggtatgttatcct

SEQ ID NO: 8376 - DNA, 20 bp, Artificial Sequence
  Synthetic polynucleotide
cactgtcgatggctgcacga

SEQ ID NO: 8377 - DNA, 20 bp, Artificial Sequence
  Synthetic polynucleotide
tgctgagcagtgtggaagtg

SEQ ID NO: 8378 - DNA, 20 bp, Artificial Sequence
  Synthetic polynucleotide
tgcactcaaagggcactcaa

SEQ ID NO: 8379 - DNA, 20 bp, Artificial Sequence
  Synthetic polynucleotide
gatacatcccagactagact

SEQ ID NO: 8380 - DNA, 20 bp, Artificial Sequence
  Synthetic polynucleotide
gtgggtgctgagggtgccga

SEQ ID NO: 8381 - DNA, 20 bp, Artificial Sequence
  Synthetic polynucleotide
cgaagctcaaggtggagaca

SEQ ID NO: 8382 - DNA, 20 bp, Artificial Sequence
  Synthetic polynucleotide
atatcagtctgtgggactgt

SEQ ID NO: 8383 - DNA, 20 bp, Artificial Sequence
  Synthetic polynucleotide
ctgtgtgttaacactagcta

SEQ ID NO: 8384 - DNA, 20 bp, Artificial Sequence
  Synthetic polynucleotide
cgctgtccgaggagcgtccg

SEQ ID NO: 8385 - DNA, 20 bp, Artificial Sequence
  Synthetic polynucleotide
gccagtgtggaagaacagtg

SEQ ID NO: 8386 - DNA, 20 bp, Artificial Sequence
  Synthetic polynucleotide
gcttctgtgctcctggctcc

SEQ ID NO: 8387 - DNA, 20 bp, Artificial Sequence
  Synthetic polynucleotide
agacaaaaggaggatcaagg

SEQ ID NO: 8388 - DNA, 20 bp, Artificial Sequence
  Synthetic polynucleotide
cgcgcctggccccggggccc

SEQ ID NO: 8389 - DNA, 20 bp, Artificial Sequence
  Synthetic polynucleotide
aactcaggttcggttttaat

SEQ ID NO: 8390 - DNA, 20 bp, Artificial Sequence
  Synthetic polynucleotide
aacagaaaaaagagggaaag

SEQ ID NO: 8391 - DNA, 20 bp, Artificial Sequence
  Synthetic polynucleotide
cgccggccgcacccccgcct

SEQ ID NO: 8392 - DNA, 20 bp, Artificial Sequence
  Synthetic polynucleotide
agccttgactgttgagcagc

SEQ ID NO: 8393 - DNA, 20 bp, Artificial Sequence
  Synthetic polynucleotide
ccccccgaggagccaccccg

SEQ ID NO: 8394 - DNA, 20 bp, Artificial Sequence
  Synthetic polynucleotide
ttcaccgtcaccgtccgtcc

SEQ ID NO: 8395 - DNA, 20 bp, Artificial Sequence
  Synthetic polynucleotide
cgcaagatggaggtgggagg

SEQ ID NO: 8396 - DNA, 20 bp, Artificial Sequence
  Synthetic polynucleotide
ttgccgggttcgcctcccgg

SEQ ID NO: 8397 - DNA, 20 bp, Artificial Sequence
  Synthetic polynucleotide
tccgggctaaagaagccccc

SEQ ID NO: 8398 - DNA, 20 bp, Artificial Sequence
  Synthetic polynucleotide
agatgagaaggggaggagaa

SEQ ID NO: 8399 - DNA, 20 bp, Artificial Sequence
  Synthetic polynucleotide
atcagtggggcgctggagtg

SEQ ID NO: 8400 - DNA, 20 bp, Artificial Sequence
  Synthetic polynucleotide
cattgggacaaagtatccat

SEQ ID NO: 8401 - DNA, 20 bp, Artificial Sequence
  Synthetic polynucleotide
ccataacagcatcaggagtc

SEQ ID NO: 8402 - DNA, 20 bp, Artificial Sequence
  Synthetic polynucleotide
ttggtgcatgaggatgcatg

SEQ ID NO: 8403 - DNA, 20 bp, Artificial Sequence
  Synthetic polynucleotide
atgtatatgcaactggttgg

SEQ ID NO: 8404 - DNA, 20 bp, Artificial Sequence
  Synthetic polynucleotide
accacaggtgagcaccgacc

SEQ ID NO: 8405 - DNA, 20 bp, Artificial Sequence
  Synthetic polynucleotide
ggtgatcaaacgccccgccc

SEQ ID NO: 8406 - DNA, 20 bp, Artificial Sequence
  Synthetic polynucleotide
agcagctgacagagggttag

SEQ ID NO: 8407 - DNA, 20 bp, Artificial Sequence
  Synthetic polynucleotide
tcccccagaaaaaggtgcaa

SEQ ID NO: 8408 - DNA, 20 bp, Artificial Sequence
  Synthetic polynucleotide
ctgcaattgaggcaaaattg

SEQ ID NO: 8409 - DNA, 20 bp, Artificial Sequence
  Synthetic polynucleotide
gctggagatctcggaggcat

SEQ ID NO: 8410 - DNA, 20 bp, Artificial Sequence
  Synthetic polynucleotide
ggctgccttcgggccgcctt

SEQ ID NO: 8411 - DNA, 20 bp, Artificial Sequence
  Synthetic polynucleotide
ctgaaggggaaggctcgaag

SEQ ID NO: 8412 - DNA, 20 bp, Artificial Sequence
  Synthetic polynucleotide
ctgctccacagggttcattc

SEQ ID NO: 8413 - DNA, 20 bp, Artificial Sequence
  Synthetic polynucleotide
catgggcatgcagggcatgc

SEQ ID NO: 8414 - DNA, 20 bp, Artificial Sequence
  Synthetic polynucleotide
gtctccagccttgtctgtct

SEQ ID NO: 8415 - DNA, 20 bp, Artificial Sequence
  Synthetic polynucleotide
acactggatatttgagccac

SEQ ID NO: 8416 - DNA, 20 bp, Artificial Sequence
  Synthetic polynucleotide
gccaggtagcccaggttggt

SEQ ID NO: 8417 - DNA, 20 bp, Artificial Sequence
  Synthetic polynucleotide
cagagttccacacggcatca

SEQ ID NO: 8418 - DNA, 20 bp, Artificial Sequence
  Synthetic polynucleotide
cacccgcggggagacggtgt

SEQ ID NO: 8419 - DNA, 20 bp, Artificial Sequence
  Synthetic polynucleotide
ggtcggcgggcgcagccggt

SEQ ID NO: 8420 - DNA, 20 bp, Artificial Sequence
  Synthetic polynucleotide
cagcttgatgaggtcagatg

SEQ ID NO: 8421 - DNA, 20 bp, Artificial Sequence
  Synthetic polynucleotide
tcaggaggagacgtctcagg

SEQ ID NO: 8422 - DNA, 20 bp, Artificial Sequence
  Synthetic polynucleotide
cggggctggcgcggctggcg

SEQ ID NO: 8423 - DNA, 20 bp, Artificial Sequence
  Synthetic polynucleotide
gcggtgcatgggctgcgcat

SEQ ID NO: 8424 - DNA, 20 bp, Artificial Sequence
  Synthetic polynucleotide
cgcggagcctcgcaggggca

SEQ ID NO: 8425 - DNA, 20 bp, Artificial Sequence
  Synthetic polynucleotide
cacagaaacatgtacagtac

SEQ ID NO: 8426 - DNA, 20 bp, Artificial Sequence
  Synthetic polynucleotide
gcccaaggtggccaagccca

SEQ ID NO: 8427 - DNA, 20 bp, Artificial Sequence
  Synthetic polynucleotide
ggcagtggtggcatgagggg

SEQ ID NO: 8428 - DNA, 20 bp, Artificial Sequence
  Synthetic polynucleotide
acgctcatagagtaactaac

SEQ ID NO: 8429 - DNA, 20 bp, Artificial Sequence
  Synthetic polynucleotide
gcggtccgggactgcggtcc

SEQ ID NO: 8430 - DNA, 20 bp, Artificial Sequence
  Synthetic polynucleotide
agaccgagttcctatggatg

SEQ ID NO: 8431 - DNA, 20 bp, Artificial Sequence
  Synthetic polynucleotide
tgtgctcactctgccaggcc

SEQ ID NO: 8432 - DNA, 20 bp, Artificial Sequence
  Synthetic polynucleotide
cttatggcagaattggccat

SEQ ID NO: 8433 - DNA, 20 bp, Artificial Sequence
  Synthetic polynucleotide
gcagaccctccgagcagagc

SEQ ID NO: 8434 - DNA, 20 bp, Artificial Sequence
  Synthetic polynucleotide
ggcggtggcggtgccggtgc

SEQ ID NO: 8435 - DNA, 20 bp, Artificial Sequence
  Synthetic polynucleotide
cgggagacggggctggagac

SEQ ID NO: 8436 - DNA, 20 bp, Artificial Sequence
  Synthetic polynucleotide
gacacaggcgtcgctgacac

SEQ ID NO: 8437 - DNA, 20 bp, Artificial Sequence
  Synthetic polynucleotide
ggagatctcggaggcatcgg

SEQ ID NO: 8438 - DNA, 20 bp, Artificial Sequence
  Synthetic polynucleotide
gggaacgtcagttaggagtt

SEQ ID NO: 8439 - DNA, 20 bp, Artificial Sequence
  Synthetic polynucleotide
cgtgggcctgtacacgtccg

SEQ ID NO: 8440 - DNA, 20 bp, Artificial Sequence
  Synthetic polynucleotide
actacgtggactgtggactg

SEQ ID NO: 8441 - DNA, 20 bp, Artificial Sequence
  Synthetic polynucleotide
acggctgtggagctgacctg

SEQ ID NO: 8442 - DNA, 20 bp, Artificial Sequence
  Synthetic polynucleotide
ctgtccctggcttttatccc

SEQ ID NO: 8443 - DNA, 20 bp, Artificial Sequence
  Synthetic polynucleotide
gcgctttatgcggatctatc

SEQ ID NO: 8444 - DNA, 20 bp, Artificial Sequence
  Synthetic polynucleotide
ttgccaaagctgttagggtt

SEQ ID NO: 8445 - DNA, 20 bp, Artificial Sequence
  Synthetic polynucleotide
caaggacgcctaccatgcat

SEQ ID NO: 8446 - DNA, 20 bp, Artificial Sequence
  Synthetic polynucleotide
ggggatgcaggtggagctgt

SEQ ID NO: 8447 - DNA, 20 bp, Artificial Sequence
  Synthetic polynucleotide
gctgcagacggagctgcaga

SEQ ID NO: 8448 - DNA, 20 bp, Artificial Sequence
  Synthetic polynucleotide
ggagccatccagcaggaagc

SEQ ID NO: 8449 - DNA, 20 bp, Artificial Sequence
  Synthetic polynucleotide
caaccacctccagcctggcc

SEQ ID NO: 8450 - DNA, 20 bp, Artificial Sequence
  Synthetic polynucleotide
aggcagcatacgcgacgcga

SEQ ID NO: 8451 - DNA, 20 bp, Artificial Sequence
  Synthetic polynucleotide
ctaagcaacatgagcttagc

SEQ ID NO: 8452 - DNA, 20 bp, Artificial Sequence
  Synthetic polynucleotide
ccgggaaggggcatgggaag

SEQ ID NO: 8453 - DNA, 20 bp, Artificial Sequence
  Synthetic polynucleotide
acagcttcagcgagccgagc

SEQ ID NO: 8454 - DNA, 20 bp, Artificial Sequence
  Synthetic polynucleotide
atgggagcagcaggtgtcga

SEQ ID NO: 8455 - DNA, 20 bp, Artificial Sequence
  Synthetic polynucleotide
gagctggggtccaggattcc

SEQ ID NO: 8456 - DNA, 20 bp, Artificial Sequence
  Synthetic polynucleotide
tcaacgcggcgctcggcgct

SEQ ID NO: 8457 - DNA, 20 bp, Artificial Sequence
  Synthetic polynucleotide
cgccgctaccggctcgccac

SEQ ID NO: 8458 - DNA, 20 bp, Artificial Sequence
  Synthetic polynucleotide
catatcagtctgtgggactg

SEQ ID NO: 8459 - DNA, 20 bp, Artificial Sequence
  Synthetic polynucleotide
cccctggagaccagcatcat

SEQ ID NO: 8460 - DNA, 20 bp, Artificial Sequence
  Synthetic polynucleotide
atcagggccagctggccagc

SEQ ID NO: 8461 - DNA, 20 bp, Artificial Sequence
  Synthetic polynucleotide
ccccggacggtgacggcgga

SEQ ID NO: 8462 - DNA, 20 bp, Artificial Sequence
  Synthetic polynucleotide
ctgcagaacattgggaacat

SEQ ID NO: 8463 - DNA, 20 bp, Artificial Sequence
  Synthetic polynucleotide
tgcccctactgcgaccgacc

SEQ ID NO: 8464 - DNA, 20 bp, Artificial Sequence
  Synthetic polynucleotide
cttcgtgggcaaggtgtggc

SEQ ID NO: 8465 - DNA, 20 bp, Artificial Sequence
  Synthetic polynucleotide
ggccttccgctacagacaga

SEQ ID NO: 8466 - DNA, 20 bp, Artificial Sequence
  Synthetic polynucleotide
ctgagaaggttgccccgaga

SEQ ID NO: 8467 - DNA, 20 bp, Artificial Sequence
  Synthetic polynucleotide
tcagaaggggtaatccagaa

SEQ ID NO: 8468 - DNA, 20 bp, Artificial Sequence
  Synthetic polynucleotide
acgttgccaaagtagtcagt

SEQ ID NO: 8469 - DNA, 20 bp, Artificial Sequence
  Synthetic polynucleotide
gggtcagcctggaggcctgg

SEQ ID NO: 8470 - DNA, 20 bp, Artificial Sequence
  Synthetic polynucleotide
tgacccggtagtagggtagt

SEQ ID NO: 8471 - DNA, 20 bp, Artificial Sequence
  Synthetic polynucleotide
atcatggtgacacttactta

SEQ ID NO: 8472 - DNA, 20 bp, Artificial Sequence
  Synthetic polynucleotide
ggcctttgctgtggttgggt

SEQ ID NO: 8473 - DNA, 20 bp, Artificial Sequence
  Synthetic polynucleotide
ctggacaaggctgggctccc

SEQ ID NO: 8474 - DNA, 20 bp, Artificial Sequence
  Synthetic polynucleotide
aggtgttgaatggaattgaa

SEQ ID NO: 8475 - DNA, 20 bp, Artificial Sequence
  Synthetic polynucleotide
ctcttcttggatgatgactc

SEQ ID NO: 8476 - DNA, 20 bp, Artificial Sequence
  Synthetic polynucleotide
tgtccttttgctccaggcag

SEQ ID NO: 8477 - DNA, 20 bp, Artificial Sequence
  Synthetic polynucleotide
gggttccttctgaatgatga

SEQ ID NO: 8478 - DNA, 20 bp, Artificial Sequence
  Synthetic polynucleotide
tggaggtgcggaagcggaag

SEQ ID NO: 8479 - DNA, 20 bp, Artificial Sequence
  Synthetic polynucleotide
agtgaagatgacaatcatgt

SEQ ID NO: 8480 - DNA, 20 bp, Artificial Sequence
  Synthetic polynucleotide
taccagcccgacgagggacg

SEQ ID NO: 8481 - DNA, 20 bp, Artificial Sequence
  Synthetic polynucleotide
ccagttccagaagggcaata

SEQ ID NO: 8482 - DNA, 20 bp, Artificial Sequence
  Synthetic polynucleotide
atctaactgaagaggctttg

SEQ ID NO: 8483 - DNA, 20 bp, Artificial Sequence
  Synthetic polynucleotide
gcggacctcgggggcggcag

SEQ ID NO: 8484 - DNA, 20 bp, Artificial Sequence
  Synthetic polynucleotide
tggacgtagtcgccatgcca

SEQ ID NO: 8485 - DNA, 20 bp, Artificial Sequence
  Synthetic polynucleotide
actcacgtccatgtagtagt

SEQ ID NO: 8486 - DNA, 20 bp, Artificial Sequence
  Synthetic polynucleotide
agttggtccttctcggtcct

SEQ ID NO: 8487 - DNA, 20 bp, Artificial Sequence
  Synthetic polynucleotide
attggaggcctgactcactc

SEQ ID NO: 8488 - DNA, 20 bp, Artificial Sequence
  Synthetic polynucleotide
ggcggccggaagggcgcggc

SEQ ID NO: 8489 - DNA, 20 bp, Artificial Sequence
  Synthetic polynucleotide
ggccgaggacttgccgcaga

SEQ ID NO: 8490 - DNA, 20 bp, Artificial Sequence
  Synthetic polynucleotide
ggtggtcctgccggaggcgg

SEQ ID NO: 8491 - DNA, 20 bp, Artificial Sequence
  Synthetic polynucleotide
cccatgacctatactcactc

SEQ ID NO: 8492 - DNA, 20 bp, Artificial Sequence
  Synthetic polynucleotide
ttgtccttgcagtcggcagt

SEQ ID NO: 8493 - DNA, 20 bp, Artificial Sequence
  Synthetic polynucleotide
gtgggcctgtacacgtccgt

SEQ ID NO: 8494 - DNA, 20 bp, Artificial Sequence
  Synthetic polynucleotide
caccaaggaaaggagcacca

SEQ ID NO: 8495 - DNA, 20 bp, Artificial Sequence
  Synthetic polynucleotide
tgttgggctttagcattagc

SEQ ID NO: 8496 - DNA, 20 bp, Artificial Sequence
  Synthetic polynucleotide
tacatttgcttgggagtcat

SEQ ID NO: 8497 - DNA, 20 bp, Artificial Sequence
  Synthetic polynucleotide
aaggtgaagcagcatctatc

SEQ ID NO: 8498 - DNA, 20 bp, Artificial Sequence
  Synthetic polynucleotide
agggcaggcatgcactgcac

SEQ ID NO: 8499 - DNA, 20 bp, Artificial Sequence
  Synthetic polynucleotide
ggttgggatggggctggatg

SEQ ID NO: 8500 - DNA, 20 bp, Artificial Sequence
  Synthetic polynucleotide
cacggcagcgggccctcagc

SEQ ID NO: 8501 - DNA, 20 bp, Artificial Sequence
  Synthetic polynucleotide
ctgcgctgtggacactgctg

SEQ ID NO: 8502 - DNA, 20 bp, Artificial Sequence
  Synthetic polynucleotide
aagctggaactctgggactc

SEQ ID NO: 8503 - DNA, 20 bp, Artificial Sequence
  Synthetic polynucleotide
ggatgtcatctgtggatctg

SEQ ID NO: 8504 - DNA, 20 bp, Artificial Sequence
  Synthetic polynucleotide
gcggaactgggggcggaact

SEQ ID NO: 8505 - DNA, 20 bp, Artificial Sequence
  Synthetic polynucleotide
tcggctggtgctgcctcggc

SEQ ID NO: 8506 - DNA, 20 bp, Artificial Sequence
  Synthetic polynucleotide
tccagcctggagtcccaggc

SEQ ID NO: 8507 - DNA, 20 bp, Artificial Sequence
  Synthetic polynucleotide
cggaggcgggggtgcggccg

SEQ ID NO: 8508 - DNA, 20 bp, Artificial Sequence
  Synthetic polynucleotide
cttgtccgtgcgcctgcctg

SEQ ID NO: 8509 - DNA, 20 bp, Artificial Sequence
  Synthetic polynucleotide
cgtcgccccggggccgcccc

SEQ ID NO: 8510 - DNA, 20 bp, Artificial Sequence
  Synthetic polynucleotide
ctgcgctgagggcccgctga

SEQ ID NO: 8511 - DNA, 20 bp, Artificial Sequence
  Synthetic polynucleotide
gagtcgtcggtgcggtggtg

SEQ ID NO: 8512 - DNA, 20 bp, Artificial Sequence
  Synthetic polynucleotide
tgctgcggacgccgggacgc

SEQ ID NO: 8513 - DNA, 20 bp, Artificial Sequence
  Synthetic polynucleotide
gcccctgcccctgctgactg

SEQ ID NO: 8514 - DNA, 20 bp, Artificial Sequence
  Synthetic polynucleotide
ctttgtggtggacatgatga

SEQ ID NO: 8515 - DNA, 20 bp, Artificial Sequence
  Synthetic polynucleotide
ttgctggtgaagtggttaag

SEQ ID NO: 8516 - DNA, 20 bp, Artificial Sequence
  Synthetic polynucleotide
cgctcccggtgccccgctcc

SEQ ID NO: 8517 - DNA, 20 bp, Artificial Sequence
  Synthetic polynucleotide
ggtgctcacggccatggcca

SEQ ID NO: 8518 - DNA, 20 bp, Artificial Sequence
  Synthetic polynucleotide
ggcaactgcagcccggacgg

SEQ ID NO: 8519 - DNA, 20 bp, Artificial Sequence
  Synthetic polynucleotide
tctctgcctgcaggatgagc

SEQ ID NO: 8520 - DNA, 20 bp, Artificial Sequence
  Synthetic polynucleotide
ggcggaactgggggcggaac

SEQ ID NO: 8521 - DNA, 20 bp, Artificial Sequence
  Synthetic polynucleotide
ggcctcggctggtgctgcct

SEQ ID NO: 8522 - DNA, 20 bp, Artificial Sequence
  Synthetic polynucleotide
tgggtttgaaggatgcgatg

SEQ ID NO: 8523 - DNA, 20 bp, Artificial Sequence
  Synthetic polynucleotide
tagtggccatgcacgtcacg

SEQ ID NO: 8524 - DNA, 20 bp, Artificial Sequence
  Synthetic polynucleotide
agcagaccagggccccacca

SEQ ID NO: 8525 - DNA, 20 bp, Artificial Sequence
  Synthetic polynucleotide
gcaggctgacgagtgcctgc

SEQ ID NO: 8526 - DNA, 20 bp, Artificial Sequence
  Synthetic polynucleotide
cagccatttcgaaaggcagg

SEQ ID NO: 8527 - DNA, 20 bp, Artificial Sequence
  Synthetic polynucleotide
gagggtcggcctcagctttt

SEQ ID NO: 8528 - DNA, 20 bp, Artificial Sequence
  Synthetic polynucleotide
gcattgcacaggtattgcac

SEQ ID NO: 8529 - DNA, 20 bp, Artificial Sequence
  Synthetic polynucleotide
agcggctggcggctggcggc

SEQ ID NO: 8530 - DNA, 20 bp, Artificial Sequence
  Synthetic polynucleotide
cgggcagggccacacgcgcc

SEQ ID NO: 8531 - DNA, 20 bp, Artificial Sequence
  Synthetic polynucleotide
cagaggcagtgtggacagtg

SEQ ID NO: 8532 - DNA, 20 bp, Artificial Sequence
  Synthetic polynucleotide
cccaggagtgaactggtgtc

SEQ ID NO: 8533 - DNA, 20 bp, Artificial Sequence
  Synthetic polynucleotide
gtcgccccggggccgccccg

SEQ ID NO: 8534 - DNA, 20 bp, Artificial Sequence
  Synthetic polynucleotide
tttggaagatgagccacctt

SEQ ID NO: 8535 - DNA, 20 bp, Artificial Sequence
  Synthetic polynucleotide
aggacaagcagattcattca

SEQ ID NO: 8536 - DNA, 20 bp, Artificial Sequence
  Synthetic polynucleotide
tgtggctcctgcggctcctg

SEQ ID NO: 8537 - DNA, 20 bp, Artificial Sequence
  Synthetic polynucleotide
gcaggacaacagatggctga

SEQ ID NO: 8538 - DNA, 20 bp, Artificial Sequence
  Synthetic polynucleotide
aatggtcttgtgaagggtga

SEQ ID NO: 8539 - DNA, 20 bp, Artificial Sequence
  Synthetic polynucleotide
gactgcaaggacagactgca

SEQ ID NO: 8540 - DNA, 20 bp, Artificial Sequence
  Synthetic polynucleotide
agctggctgggaacaccagc

SEQ ID NO: 8541 - DNA, 20 bp, Artificial Sequence
  Synthetic polynucleotide
ccggcggtggggcggtgggg

SEQ ID NO: 8542 - DNA, 20 bp, Artificial Sequence
  Synthetic polynucleotide
caagaccgaacactacttac

SEQ ID NO: 8543 - DNA, 20 bp, Artificial Sequence
  Synthetic polynucleotide
agatccaggcctgtggcatg

SEQ ID NO: 8544 - DNA, 20 bp, Artificial Sequence
  Synthetic polynucleotide
acccgcggggagacggtgtg

SEQ ID NO: 8545 - DNA, 20 bp, Artificial Sequence
  Synthetic polynucleotide
tcggcataagtggaccgacc

SEQ ID NO: 8546 - DNA, 20 bp, Artificial Sequence
  Synthetic polynucleotide
agccgtgctcgtggtgctcg

SEQ ID NO: 8547 - DNA, 20 bp, Artificial Sequence
  Synthetic polynucleotide
cctccggatggttttggttt

SEQ ID NO: 8548 - DNA, 20 bp, Artificial Sequence
  Synthetic polynucleotide
ggtcggcggccccggggcga

SEQ ID NO: 8549 - DNA, 20 bp, Artificial Sequence
  Synthetic polynucleotide
acacctggaaaggtcaggtc

SEQ ID NO: 8550 - DNA, 20 bp, Artificial Sequence
  Synthetic polynucleotide
tctcccagaggaagttatag

SEQ ID NO: 8551 - DNA, 20 bp, Artificial Sequence
  Synthetic polynucleotide
tacaccgaggacgtggggtg

SEQ ID NO: 8552 - DNA, 20 bp, Artificial Sequence
  Synthetic polynucleotide
gtgatccggagatcggagat

SEQ ID NO: 8553 - DNA, 20 bp, Artificial Sequence
  Synthetic polynucleotide
gcggtgcggcggccgcgcgg

SEQ ID NO: 8554 - DNA, 20 bp, Artificial Sequence
  Synthetic polynucleotide
tgtggacctgaagccttcct

SEQ ID NO: 8555 - DNA, 20 bp, Artificial Sequence
  Synthetic polynucleotide
ggcccggggaccaggggacc

SEQ ID NO: 8556 - DNA, 20 bp, Artificial Sequence
  Synthetic polynucleotide
aaggtcagctggtagcgtag

SEQ ID NO: 8557 - DNA, 20 bp, Artificial Sequence
  Synthetic polynucleotide
gaccgcaagatggaggtggg

SEQ ID NO: 8558 - DNA, 20 bp, Artificial Sequence
  Synthetic polynucleotide
gctgggatgctgggccccgc

SEQ ID NO: 8559 - DNA, 20 bp, Artificial Sequence
  Synthetic polynucleotide
gcctcgatgtcgtcggccgt

SEQ ID NO: 8560 - DNA, 20 bp, Artificial Sequence
  Synthetic polynucleotide
ggccgtagtacatgacatga

SEQ ID NO: 8561 - DNA, 20 bp, Artificial Sequence
  Synthetic polynucleotide
gtgctcactctgccaggcca

SEQ ID NO: 8562 - DNA, 20 bp, Artificial Sequence
  Synthetic polynucleotide
gctagtatggaggatctggg

SEQ ID NO: 8563 - DNA, 20 bp, Artificial Sequence
  Synthetic polynucleotide
caagacattcacgtggttcg

SEQ ID NO: 8564 - DNA, 20 bp, Artificial Sequence
  Synthetic polynucleotide
aatgtcaaaacggagctgaa

SEQ ID NO: 8565 - DNA, 20 bp, Artificial Sequence
  Synthetic polynucleotide
agcaccaggcactggggctg

SEQ ID NO: 8566 - DNA, 20 bp, Artificial Sequence
  Synthetic polynucleotide
ggcaccaggacgtatgggta

SEQ ID NO: 8567 - DNA, 20 bp, Artificial Sequence
  Synthetic polynucleotide
gtcacagacacagatccatc

SEQ ID NO: 8568 - DNA, 20 bp, Artificial Sequence
  Synthetic polynucleotide
ctcgctcattcactccctcc

SEQ ID NO: 8569 - DNA, 20 bp, Artificial Sequence
  Synthetic polynucleotide
ccgttcgcggcggacggcgg

SEQ ID NO: 8570 - DNA, 20 bp, Artificial Sequence
  Synthetic polynucleotide
ccggctgcgctgcgctgcgc

SEQ ID NO: 8571 - DNA, 20 bp, Artificial Sequence
  Synthetic polynucleotide
gaatatcgtgtagagataga

SEQ ID NO: 8572 - DNA, 20 bp, Artificial Sequence
  Synthetic polynucleotide
aaaagccagggataaaagcc

SEQ ID NO: 8573 - DNA, 20 bp, Artificial Sequence
  Synthetic polynucleotide
tacggggccaaccaggtagg

SEQ ID NO: 8574 - DNA, 20 bp, Artificial Sequence
  Synthetic polynucleotide
tctggtcctgttggtcctgt

SEQ ID NO: 8575 - DNA, 20 bp, Artificial Sequence
  Synthetic polynucleotide
ctacatcccgcagagcgcag

SEQ ID NO: 8576 - DNA, 20 bp, Artificial Sequence
  Synthetic polynucleotide
ggcggcgcgggcctcccgcg

SEQ ID NO: 8577 - DNA, 20 bp, Artificial Sequence
  Synthetic polynucleotide
ccgccactcgagcgtgcgtg

SEQ ID NO: 8578 - DNA, 20 bp, Artificial Sequence
  Synthetic polynucleotide
cgccgccgccgtggccgccg

SEQ ID NO: 8579 - DNA, 20 bp, Artificial Sequence
  Synthetic polynucleotide
ggggcccccacactacgctg

SEQ ID NO: 8580 - DNA, 20 bp, Artificial Sequence
  Synthetic polynucleotide
ggtgcagctgtcggtggggt

SEQ ID NO: 8581 - DNA, 20 bp, Artificial Sequence
  Synthetic polynucleotide
gttggcaccaggcacggacg

SEQ ID NO: 8582 - DNA, 20 bp, Artificial Sequence
  Synthetic polynucleotide
cagtgctggcggcgtcctgg

SEQ ID NO: 8583 - DNA, 20 bp, Artificial Sequence
  Synthetic polynucleotide
gctcagcatctgtcagtcag

SEQ ID NO: 8584 - DNA, 20 bp, Artificial Sequence
  Synthetic polynucleotide
gccccggggcgacggccccg

SEQ ID NO: 8585 - DNA, 20 bp, Artificial Sequence
  Synthetic polynucleotide
ccttcccagtgaggcaggca

SEQ ID NO: 8586 - DNA, 20 bp, Artificial Sequence
  Synthetic polynucleotide
gtgggagctggacctggacc

SEQ ID NO: 8587 - DNA, 20 bp, Artificial Sequence
  Synthetic polynucleotide
caactgctaaagcaagaaag

SEQ ID NO: 8588 - DNA, 20 bp, Artificial Sequence
  Synthetic polynucleotide
gtctatgtgctgtgctgtgc

SEQ ID NO: 8589 - DNA, 20 bp, Artificial Sequence
  Synthetic polynucleotide
tgacggaacttgcgctccag

SEQ ID NO: 8590 - DNA, 20 bp, Artificial Sequence
  Synthetic polynucleotide
aggccccttgcaatgtgggt

SEQ ID NO: 8591 - DNA, 20 bp, Artificial Sequence
  Synthetic polynucleotide
ctgttctgaaggcaggtgca

SEQ ID NO: 8592 - DNA, 20 bp, Artificial Sequence
  Synthetic polynucleotide
cgacggcagctctccgacga

SEQ ID NO: 8593 - DNA, 20 bp, Artificial Sequence
  Synthetic polynucleotide
cggaagagcagggagtaagt

SEQ ID NO: 8594 - DNA, 20 bp, Artificial Sequence
  Synthetic polynucleotide
atatccctcagtacaggagc

SEQ ID NO: 8595 - DNA, 20 bp, Artificial Sequence
  Synthetic polynucleotide
acctcctccagccagccagc

SEQ ID NO: 8596 - DNA, 20 bp, Artificial Sequence
  Synthetic polynucleotide
accgtgcatttctgcatttc

SEQ ID NO: 8597 - DNA, 20 bp, Artificial Sequence
  Synthetic polynucleotide
ccgggataccttggtatata

SEQ ID NO: 8598 - DNA, 20 bp, Artificial Sequence
  Synthetic polynucleotide
acatcatgtgcggggatgcg

SEQ ID NO: 8599 - DNA, 20 bp, Artificial Sequence
  Synthetic polynucleotide
accaacctggagcgtgagtg

SEQ ID NO: 8600 - DNA, 20 bp, Artificial Sequence
  Synthetic polynucleotide
ctgggctgtgaatgagggag

SEQ ID NO: 8601 - DNA, 20 bp, Artificial Sequence
  Synthetic polynucleotide
catgggcgcgcgcgcccaca

SEQ ID NO: 8602 - DNA, 20 bp, Artificial Sequence
  Synthetic polynucleotide
gtgctcagcattggcagcat

SEQ ID NO: 8603 - DNA, 20 bp, Artificial Sequence
  Synthetic polynucleotide
tgcaggtatgtcctatgtcc

SEQ ID NO: 8604 - DNA, 20 bp, Artificial Sequence
  Synthetic polynucleotide
ccaggaagtcttggaagtct

SEQ ID NO: 8605 - DNA, 20 bp, Artificial Sequence
  Synthetic polynucleotide
atgctcttctgcagagggag

SEQ ID NO: 8606 - DNA, 20 bp, Artificial Sequence
  Synthetic polynucleotide
atgaacatgggtatgaacat

SEQ ID NO: 8607 - DNA, 20 bp, Artificial Sequence
  Synthetic polynucleotide
caatgaacttacgcttggta

SEQ ID NO: 8608 - DNA, 20 bp, Artificial Sequence
  Synthetic polynucleotide
ttcttggaatggccttggaa

SEQ ID NO: 8609 - DNA, 20 bp, Artificial Sequence
  Synthetic polynucleotide
cccttcccagtgaggcaggc

SEQ ID NO: 8610 - DNA, 20 bp, Artificial Sequence
  Synthetic polynucleotide
tgtctctcttggcagtcagt

SEQ ID NO: 8611 - DNA, 20 bp, Artificial Sequence
  Synthetic polynucleotide
ggcggcggggctggcgcggc

SEQ ID NO: 8612 - DNA, 20 bp, Artificial Sequence
  Synthetic polynucleotide
cagtgtatcgctcccggccc

SEQ ID NO: 8613 - DNA, 20 bp, Artificial Sequence
  Synthetic polynucleotide
ggggagacggtgtggggaga

SEQ ID NO: 8614 - DNA, 20 bp, Artificial Sequence
  Synthetic polynucleotide
gagccaaaaaggccatgcat

SEQ ID NO: 8615 - DNA, 20 bp, Artificial Sequence
  Synthetic polynucleotide
ttgccctgggactccagcct

SEQ ID NO: 8616 - DNA, 20 bp, Artificial Sequence
  Synthetic polynucleotide
aaggtgatctcgcagctagc

SEQ ID NO: 8617 - DNA, 20 bp, Artificial Sequence
  Synthetic polynucleotide
atgggcatgcagggcatgca

SEQ ID NO: 8618 - DNA, 20 bp, Artificial Sequence
  Synthetic polynucleotide
tagcggagggcgcggggcgc

SEQ ID NO: 8619 - DNA, 20 bp, Artificial Sequence
  Synthetic polynucleotide
atggatcttacagggttaca

SEQ ID NO: 8620 - DNA, 20 bp, Artificial Sequence
  Synthetic polynucleotide
cgcgtccgcgccatgggcca

SEQ ID NO: 8621 - DNA, 20 bp, Artificial Sequence
  Synthetic polynucleotide
cccaacggttaccgttaccg

SEQ ID NO: 8622 - DNA, 20 bp, Artificial Sequence
  Synthetic polynucleotide
gagtgaaacagggatctatc

SEQ ID NO: 8623 - DNA, 20 bp, Artificial Sequence
  Synthetic polynucleotide
gagaggctgccggacaggac

SEQ ID NO: 8624 - DNA, 20 bp, Artificial Sequence
  Synthetic polynucleotide
ccaatgcaggcctcacacac

SEQ ID NO: 8625 - DNA, 20 bp, Artificial Sequence
  Synthetic polynucleotide
tctgcacgctctgcaatcaa

SEQ ID NO: 8626 - DNA, 20 bp, Artificial Sequence
  Synthetic polynucleotide
agggtcgaggtaagggaaaa

SEQ ID NO: 8627 - DNA, 20 bp, Artificial Sequence
  Synthetic polynucleotide
ctgcggggccacggtcggtc

SEQ ID NO: 8628 - DNA, 20 bp, Artificial Sequence
  Synthetic polynucleotide
ggtcatgagcaacatggtca

SEQ ID NO: 8629 - DNA, 20 bp, Artificial Sequence
  Synthetic polynucleotide
gctgccttcgggccgccttc

SEQ ID NO: 8630 - DNA, 20 bp, Artificial Sequence
  Synthetic polynucleotide
aagctggcgggaccacacac

SEQ ID NO: 8631 - DNA, 20 bp, Artificial Sequence
  Synthetic polynucleotide
tatagagtgtggtataaatg

SEQ ID NO: 8632 - DNA, 20 bp, Artificial Sequence
  Synthetic polynucleotide
gtcaccatcagcctcaatca

SEQ ID NO: 8633 - DNA, 20 bp, Artificial Sequence
  Synthetic polynucleotide
tgtccttgcagtcggcagtc

SEQ ID NO: 8634 - DNA, 20 bp, Artificial Sequence
  Synthetic polynucleotide
tggccggggccgggggccgg

SEQ ID NO: 8635 - DNA, 20 bp, Artificial Sequence
  Synthetic polynucleotide
ttctttaaacgagaaggaga

SEQ ID NO: 8636 - DNA, 20 bp, Artificial Sequence
  Synthetic polynucleotide
gcatggttcactctgaacgg

SEQ ID NO: 8637 - DNA, 20 bp, Artificial Sequence
  Synthetic polynucleotide
acccactggacactggacac

SEQ ID NO: 8638 - DNA, 20 bp, Artificial Sequence
  Synthetic polynucleotide
ggctggcagacggggccaga

SEQ ID NO: 8639 - DNA, 20 bp, Artificial Sequence
  Synthetic polynucleotide
agggagctcaccagacagac

SEQ ID NO: 8640 - DNA, 20 bp, Artificial Sequence
  Synthetic polynucleotide
aggcacgagcggcgcacgag

SEQ ID NO: 8641 - DNA, 20 bp, Artificial Sequence
  Synthetic polynucleotide
aaccacctccagcctggcct

SEQ ID NO: 8642 - DNA, 20 bp, Artificial Sequence
  Synthetic polynucleotide
ggcaaggaggtggggttgtg

SEQ ID NO: 8643 - DNA, 20 bp, Artificial Sequence
  Synthetic polynucleotide
agggaggcgcgcacgctcgg

SEQ ID NO: 8644 - DNA, 20 bp, Artificial Sequence
  Synthetic polynucleotide
ctggcagacggggccagacg

SEQ ID NO: 8645 - DNA, 20 bp, Artificial Sequence
  Synthetic polynucleotide
gcggcgcgggcctcccgcgc

SEQ ID NO: 8646 - DNA, 20 bp, Artificial Sequence
  Synthetic polynucleotide
aaaataccaatctattgttg

SEQ ID NO: 8647 - DNA, 20 bp, Artificial Sequence
  Synthetic polynucleotide
aagctgaggccgaaaagctg

SEQ ID NO: 8648 - DNA, 20 bp, Artificial Sequence
  Synthetic polynucleotide
ccaggtcggccaggcaggcc

SEQ ID NO: 8649 - DNA, 20 bp, Artificial Sequence
  Synthetic polynucleotide
gaaggcagggacttgacttg

SEQ ID NO: 8650 - DNA, 20 bp, Artificial Sequence
  Synthetic polynucleotide
tctcaaggttatgcttctca

SEQ ID NO: 8651 - DNA, 20 bp, Artificial Sequence
  Synthetic polynucleotide
tcttaccaacatctggtcaa

SEQ ID NO: 8652 - DNA, 20 bp, Artificial Sequence
  Synthetic polynucleotide
gaacatcggggctgcggtgc

SEQ ID NO: 8653 - DNA, 20 bp, Artificial Sequence
  Synthetic polynucleotide
ttgtccttgcagtcggggcg

SEQ ID NO: 8654 - DNA, 20 bp, Artificial Sequence
  Synthetic polynucleotide
gtagtgattggctgattgat

SEQ ID NO: 8655 - DNA, 20 bp, Artificial Sequence
  Synthetic polynucleotide
gcgcggcgcacgggtccgcg

SEQ ID NO: 8656 - DNA, 20 bp, Artificial Sequence
  Synthetic polynucleotide
gcgactgggtgcgctggcgc

SEQ ID NO: 8657 - DNA, 20 bp, Artificial Sequence
  Synthetic polynucleotide
gcggggagagatgactgact

SEQ ID NO: 8658 - DNA, 20 bp, Artificial Sequence
  Synthetic polynucleotide
ataaacacagagggagtgag

SEQ ID NO: 8659 - DNA, 20 bp, Artificial Sequence
  Synthetic polynucleotide
cagaaggcagctggcgggga

SEQ ID NO: 8660 - DNA, 20 bp, Artificial Sequence
  Synthetic polynucleotide
atcagtgcgaggtcggcatg

SEQ ID NO: 8661 - DNA, 20 bp, Artificial Sequence
  Synthetic polynucleotide
tgcgcacggggtcccggccc

SEQ ID NO: 8662 - DNA, 20 bp, Artificial Sequence
  Synthetic polynucleotide
ccagctactggcccagctac

SEQ ID NO: 8663 - DNA, 20 bp, Artificial Sequence
  Synthetic polynucleotide
gaaatgtcgcacggccggcc

SEQ ID NO: 8664 - DNA, 20 bp, Artificial Sequence
  Synthetic polynucleotide
ttcagctcctgcatggtgca

SEQ ID NO: 8665 - DNA, 20 bp, Artificial Sequence
  Synthetic polynucleotide
cggccccggggcgacggccc

SEQ ID NO: 8666 - DNA, 20 bp, Artificial Sequence
  Synthetic polynucleotide
cgaatctcatctcacctcac

SEQ ID NO: 8667 - DNA, 20 bp, Artificial Sequence
  Synthetic polynucleotide
gtccgcctctggtccgcctc

SEQ ID NO: 8668 - DNA, 20 bp, Artificial Sequence
  Synthetic polynucleotide
caaggggatggtactctctc

SEQ ID NO: 8669 - DNA, 20 bp, Artificial Sequence
  Synthetic polynucleotide
tggacagccacacagcacac

SEQ ID NO: 8670 - DNA, 20 bp, Artificial Sequence
  Synthetic polynucleotide
gctgcggacgccgggacgcc

SEQ ID NO: 8671 - DNA, 20 bp, Artificial Sequence
  Synthetic polynucleotide
ggaactgtgcgctggtgcgc

SEQ ID NO: 8672 - DNA, 20 bp, Artificial Sequence
  Synthetic polynucleotide
ggcccgggaggcgaaccccc

SEQ ID NO: 8673 - DNA, 20 bp, Artificial Sequence
  Synthetic polynucleotide
attttggctttctgtatgta

SEQ ID NO: 8674 - DNA, 20 bp, Artificial Sequence
  Synthetic polynucleotide
caccacatccacagacagac

SEQ ID NO: 8675 - DNA, 20 bp, Artificial Sequence
  Synthetic polynucleotide
ttgcccttggtgagcacgct

SEQ ID NO: 8676 - DNA, 20 bp, Artificial Sequence
  Synthetic polynucleotide
actgcaaggacaaatctgaa

SEQ ID NO: 8677 - DNA, 20 bp, Artificial Sequence
  Synthetic polynucleotide
caggtggccgtcgaggaccg

SEQ ID NO: 8678 - DNA, 20 bp, Artificial Sequence
  Synthetic polynucleotide
aagggcagtggtgagcaagc

SEQ ID NO: 8679 - DNA, 20 bp, Artificial Sequence
  Synthetic polynucleotide
gaggccaaagaaacccaccc

SEQ ID NO: 8680 - DNA, 20 bp, Artificial Sequence
  Synthetic polynucleotide
ttccagttacctccatggca

SEQ ID NO: 8681 - DNA, 20 bp, Artificial Sequence
  Synthetic polynucleotide
tccccatggtgatgcaagca

SEQ ID NO: 8682 - DNA, 20 bp, Artificial Sequence
  Synthetic polynucleotide
ctgcgccgggaggcccgcgc

SEQ ID NO: 8683 - DNA, 20 bp, Artificial Sequence
  Synthetic polynucleotide
aagagggccccattccacca

SEQ ID NO: 8684 - DNA, 20 bp, Artificial Sequence
  Synthetic polynucleotide
aggcgcagcagggccgcagc

SEQ ID NO: 8685 - DNA, 20 bp, Artificial Sequence
  Synthetic polynucleotide
tgaacttacagatgggtggg

SEQ ID NO: 8686 - DNA, 20 bp, Artificial Sequence
  Synthetic polynucleotide
gacccagcccggccaggagc

SEQ ID NO: 8687 - DNA, 20 bp, Artificial Sequence
  Synthetic polynucleotide
tcacccctggatatatgtat

SEQ ID NO: 8688 - DNA, 20 bp, Artificial Sequence
  Synthetic polynucleotide
gtgctgaagatgaaagaaag

SEQ ID NO: 8689 - DNA, 20 bp, Artificial Sequence
  Synthetic polynucleotide
gctggcagacggggccagac

SEQ ID NO: 8690 - DNA, 20 bp, Artificial Sequence
  Synthetic polynucleotide
aaggtgacagtgcctgcctg

SEQ ID NO: 8691 - DNA, 20 bp, Artificial Sequence
  Synthetic polynucleotide
gcaggtccagcaaccaacca

SEQ ID NO: 8692 - DNA, 20 bp, Artificial Sequence
  Synthetic polynucleotide
cgtccgcagcccgcggcccg

SEQ ID NO: 8693 - DNA, 20 bp, Artificial Sequence
  Synthetic polynucleotide
tgccaggcacaaaacggttt

SEQ ID NO: 8694 - DNA, 20 bp, Artificial Sequence
  Synthetic polynucleotide
cttgccctgggactccagcc

SEQ ID NO: 8695 - DNA, 20 bp, Artificial Sequence
  Synthetic polynucleotide
gggggcatctatgtctgcgg

SEQ ID NO: 8696 - DNA, 20 bp, Artificial Sequence
  Synthetic polynucleotide
ccttggtgcgtcatccatcc

SEQ ID NO: 8697 - DNA, 20 bp, Artificial Sequence
  Synthetic polynucleotide
aaactggagaaaaataggat

SEQ ID NO: 8698 - DNA, 20 bp, Artificial Sequence
  Synthetic polynucleotide
gccgggcgcgatgggcgcga

SEQ ID NO: 8699 - DNA, 20 bp, Artificial Sequence
  Synthetic polynucleotide
tcagggcccgcagcaacaac

SEQ ID NO: 8700 - DNA, 20 bp, Artificial Sequence
  Synthetic polynucleotide
gctggaccagctgggccagc

SEQ ID NO: 8701 - DNA, 20 bp, Artificial Sequence
  Synthetic polynucleotide
cgccatggcgatgagcgcca

SEQ ID NO: 8702 - DNA, 20 bp, Artificial Sequence
  Synthetic polynucleotide
cggagtgaatcagctcagct

SEQ ID NO: 8703 - DNA, 20 bp, Artificial Sequence
  Synthetic polynucleotide
accagggcagctacggtttc

SEQ ID NO: 8704 - DNA, 20 bp, Artificial Sequence
  Synthetic polynucleotide
aggctgctgcggccctgctg

SEQ ID NO: 8705 - DNA, 20 bp, Artificial Sequence
  Synthetic polynucleotide
ccacgctggtgctgcagggc

SEQ ID NO: 8706 - DNA, 20 bp, Artificial Sequence
  Synthetic polynucleotide
cggaatactggttgtttgtt

SEQ ID NO: 8707 - DNA, 20 bp, Artificial Sequence
  Synthetic polynucleotide
gtgagcataacactacatac

SEQ ID NO: 8708 - DNA, 20 bp, Artificial Sequence
  Synthetic polynucleotide
ccagacactacaacaacaac

SEQ ID NO: 8709 - DNA, 20 bp, Artificial Sequence
  Synthetic polynucleotide
catgtcaaggagatagatag

SEQ ID NO: 8710 - DNA, 20 bp, Artificial Sequence
  Synthetic polynucleotide
agcgatcaggatgaccacca

SEQ ID NO: 8711 - DNA, 20 bp, Artificial Sequence
  Synthetic polynucleotide
cgggggagctgcagtccgtc

SEQ ID NO: 8712 - DNA, 20 bp, Artificial Sequence
  Synthetic polynucleotide
aggaggtgggggctggggcg

SEQ ID NO: 8713 - DNA, 20 bp, Artificial Sequence
  Synthetic polynucleotide
agctctgcgtgaaccgaacc

SEQ ID NO: 8714 - DNA, 20 bp, Artificial Sequence
  Synthetic polynucleotide
gccgcgagaggttatgggag

SEQ ID NO: 8715 - DNA, 20 bp, Artificial Sequence
  Synthetic polynucleotide
tggttgggatggggctggat

SEQ ID NO: 8716 - DNA, 20 bp, Artificial Sequence
  Synthetic polynucleotide
tgtgatgaagctgaaggaag

SEQ ID NO: 8717 - DNA, 20 bp, Artificial Sequence
  Synthetic polynucleotide
agctctggcacagccagctc

SEQ ID NO: 8718 - DNA, 20 bp, Artificial Sequence
  Synthetic polynucleotide
ggtttggttgtcagggcccc

SEQ ID NO: 8719 - DNA, 20 bp, Artificial Sequence
  Synthetic polynucleotide
caacagcatgattgacagac

SEQ ID NO: 8720 - DNA, 20 bp, Artificial Sequence
  Synthetic polynucleotide
ggatgttgtgctgctgctgc

SEQ ID NO: 8721 - DNA, 20 bp, Artificial Sequence
  Synthetic polynucleotide
agaaagcaagagtggtggtg

SEQ ID NO: 8722 - DNA, 20 bp, Artificial Sequence
  Synthetic polynucleotide
gacgagactatctggctggc

SEQ ID NO: 8723 - DNA, 20 bp, Artificial Sequence
  Synthetic polynucleotide
ggctcataccgcgtgtggtg

SEQ ID NO: 8724 - DNA, 20 bp, Artificial Sequence
  Synthetic polynucleotide
atgggggaacgccggagaat

SEQ ID NO: 8725 - DNA, 20 bp, Artificial Sequence
  Synthetic polynucleotide
gggatacctgacaggggagg

SEQ ID NO: 8726 - DNA, 20 bp, Artificial Sequence
  Synthetic polynucleotide
actgcgctgagggcccgctg

SEQ ID NO: 8727 - DNA, 20 bp, Artificial Sequence
  Synthetic polynucleotide
ggtggcgggctgggccagcc

SEQ ID NO: 8728 - DNA, 20 bp, Artificial Sequence
  Synthetic polynucleotide
tccctgcccccaggagtgag

SEQ ID NO: 8729 - DNA, 20 bp, Artificial Sequence
  Synthetic polynucleotide
agggggtgcagggccggccg

SEQ ID NO: 8730 - DNA, 20 bp, Artificial Sequence
  Synthetic polynucleotide
gctcctgaacgtggaaggaa

SEQ ID NO: 8731 - DNA, 20 bp, Artificial Sequence
  Synthetic polynucleotide
tgaccgccttactgaaatga

SEQ ID NO: 8732 - DNA, 20 bp, Artificial Sequence
  Synthetic polynucleotide
acatcaagcgccgggacatc

SEQ ID NO: 8733 - DNA, 20 bp, Artificial Sequence
  Synthetic polynucleotide
ttagaacatatcatctggtc

SEQ ID NO: 8734 - DNA, 20 bp, Artificial Sequence
  Synthetic polynucleotide
tgtaggggttcagcagggca

SEQ ID NO: 8735 - DNA, 20 bp, Artificial Sequence
  Synthetic polynucleotide
ttctagcggccatcgaggga

SEQ ID NO: 8736 - DNA, 20 bp, Artificial Sequence
  Synthetic polynucleotide
ccttgtgatgttagttagtt

SEQ ID NO: 8737 - DNA, 20 bp, Artificial Sequence
  Synthetic polynucleotide
aggtactacgagaccgagac

SEQ ID NO: 8738 - DNA, 20 bp, Artificial Sequence
  Synthetic polynucleotide
tgtgggtgctgagggtgccg

SEQ ID NO: 8739 - DNA, 20 bp, Artificial Sequence
  Synthetic polynucleotide
ggggcggtttggggcggttt

SEQ ID NO: 8740 - DNA, 20 bp, Artificial Sequence
  Synthetic polynucleotide
catgaacacgcgcacgggca

SEQ ID NO: 8741 - DNA, 20 bp, Artificial Sequence
  Synthetic polynucleotide
ggcgcctgccccggccggcc

SEQ ID NO: 8742 - DNA, 20 bp, Artificial Sequence
  Synthetic polynucleotide
gccatgtacagcgagcgagc

SEQ ID NO: 8743 - DNA, 20 bp, Artificial Sequence
  Synthetic polynucleotide
cctgcgccgggaggcccgcg

SEQ ID NO: 8744 - DNA, 20 bp, Artificial Sequence
  Synthetic polynucleotide
ctgacgacgttccgacgttc

SEQ ID NO: 8745 - DNA, 20 bp, Artificial Sequence
  Synthetic polynucleotide
cttgagcactgtgagcactg

SEQ ID NO: 8746 - DNA, 20 bp, Artificial Sequence
  Synthetic polynucleotide
ccaggtgcacgatgcgtcgt

SEQ ID NO: 8747 - DNA, 20 bp, Artificial Sequence
  Synthetic polynucleotide
tccctctacgcctccgcctc

SEQ ID NO: 8748 - DNA, 20 bp, Artificial Sequence
  Synthetic polynucleotide
ccagctcgcgcaggctgcgc

SEQ ID NO: 8749 - DNA, 20 bp, Artificial Sequence
  Synthetic polynucleotide
gagctggcgtttctgcgcag

SEQ ID NO: 8750 - DNA, 20 bp, Artificial Sequence
  Synthetic polynucleotide
ggccacaggctctgggccac

SEQ ID NO: 8751 - DNA, 20 bp, Artificial Sequence
  Synthetic polynucleotide
gttcacggggattaccaacc

SEQ ID NO: 8752 - DNA, 20 bp, Artificial Sequence
  Synthetic polynucleotide
cctgctggacctcactcgct

SEQ ID NO: 8753 - DNA, 20 bp, Artificial Sequence
  Synthetic polynucleotide
agcggagggcgcggggcgcg

SEQ ID NO: 8754 - DNA, 20 bp, Artificial Sequence
  Synthetic polynucleotide
acgtcgccccggggccgccc

SEQ ID NO: 8755 - DNA, 20 bp, Artificial Sequence
  Synthetic polynucleotide
gttcgctgaaggggaaggga

SEQ ID NO: 8756 - DNA, 20 bp, Artificial Sequence
  Synthetic polynucleotide
cctgtgcaccatgtgtaggt

SEQ ID NO: 8757 - DNA, 20 bp, Artificial Sequence
  Synthetic polynucleotide
tcagatacagccaggctgat

SEQ ID NO: 8758 - DNA, 20 bp, Artificial Sequence
  Synthetic polynucleotide
cctgcgcacgctgcgcacgc

SEQ ID NO: 8759 - DNA, 20 bp, Artificial Sequence
  Synthetic polynucleotide
atcctggatgttgcacggca

SEQ ID NO: 8760 - DNA, 20 bp, Artificial Sequence
  Synthetic polynucleotide
ctgaggaatgcagaatgcag

SEQ ID NO: 8761 - DNA, 20 bp, Artificial Sequence
  Synthetic polynucleotide
tgtccgcggcatgcggcatg

SEQ ID NO: 8762 - DNA, 20 bp, Artificial Sequence
  Synthetic polynucleotide
ggggccgggattggatggat

SEQ ID NO: 8763 - DNA, 20 bp, Artificial Sequence
  Synthetic polynucleotide
atctgcacgcggccgccgcg

SEQ ID NO: 8764 - DNA, 20 bp, Artificial Sequence
  Synthetic polynucleotide
atccaagtaagagaagtaag

SEQ ID NO: 8765 - DNA, 20 bp, Artificial Sequence
  Synthetic polynucleotide
tggccgacagttggatggat

SEQ ID NO: 8766 - DNA, 20 bp, Artificial Sequence
  Synthetic polynucleotide
gcgtgaacctggagggtggg

SEQ ID NO: 8767 - DNA, 20 bp, Artificial Sequence
  Synthetic polynucleotide
gccgggagacggggctgctg

SEQ ID NO: 8768 - DNA, 20 bp, Artificial Sequence
  Synthetic polynucleotide
tcaccgtgcggcacagctcg

SEQ ID NO: 8769 - DNA, 20 bp, Artificial Sequence
  Synthetic polynucleotide
tggggctggctggggctggc

SEQ ID NO: 8770 - DNA, 20 bp, Artificial Sequence
  Synthetic polynucleotide
ccaacgaccatacccgtccg

SEQ ID NO: 8771 - DNA, 20 bp, Artificial Sequence
  Synthetic polynucleotide
cgcggcgctggacgacggcg

SEQ ID NO: 8772 - DNA, 20 bp, Artificial Sequence
  Synthetic polynucleotide
tgggccgggccgggcagggc

SEQ ID NO: 8773 - DNA, 20 bp, Artificial Sequence
  Synthetic polynucleotide
aaacgccccggcaggaagcc

SEQ ID NO: 8774 - DNA, 20 bp, Artificial Sequence
  Synthetic polynucleotide
tgcgagagctgcggcagctg

SEQ ID NO: 8775 - DNA, 20 bp, Artificial Sequence
  Synthetic polynucleotide
gccggaacagcacggaatcc

SEQ ID NO: 8776 - DNA, 20 bp, Artificial Sequence
  Synthetic polynucleotide
cgccccctcgcggtgcggtg

SEQ ID NO: 8777 - DNA, 20 bp, Artificial Sequence
  Synthetic polynucleotide
ggagatggaggccgggaggc

SEQ ID NO: 8778 - DNA, 20 bp, Artificial Sequence
  Synthetic polynucleotide
tgacgtggcgtggcgtggcg

SEQ ID NO: 8779 - DNA, 20 bp, Artificial Sequence
  Synthetic polynucleotide
ccaccgcacttggctgttgt

SEQ ID NO: 8780 - DNA, 20 bp, Artificial Sequence
  Synthetic polynucleotide
tgctctggactcgtgctctc

SEQ ID NO: 8781 - DNA, 20 bp, Artificial Sequence
  Synthetic polynucleotide
cgaaggcctgtgggtgctgt

SEQ ID NO: 8782 - DNA, 20 bp, Artificial Sequence
  Synthetic polynucleotide
cctatgcaggtgtccaacgg

SEQ ID NO: 8783 - DNA, 20 bp, Artificial Sequence
  Synthetic polynucleotide
gcccttgttgaggtgttgtt

SEQ ID NO: 8784 - DNA, 20 bp, Artificial Sequence
  Synthetic polynucleotide
gtgctgctgcgtgctgcgtg

SEQ ID NO: 8785 - DNA, 20 bp, Artificial Sequence
  Synthetic polynucleotide
caggcggcggtgcggcggtg

SEQ ID NO: 8786 - DNA, 20 bp, Artificial Sequence
  Synthetic polynucleotide
gaggacctgcagcgggtggg

SEQ ID NO: 8787 - DNA, 20 bp, Artificial Sequence
  Synthetic polynucleotide
cggcgggaggaggcggcggg

SEQ ID NO: 8788 - DNA, 20 bp, Artificial Sequence
  Synthetic polynucleotide
atgaagactgacaggatgga

SEQ ID NO: 8789 - DNA, 20 bp, Artificial Sequence
  Synthetic polynucleotide
agggaggcccggatgctgaa

SEQ ID NO: 8790 - DNA, 20 bp, Artificial Sequence
  Synthetic polynucleotide
cccggggccgccgacccacc

SEQ ID NO: 8791 - DNA, 20 bp, Artificial Sequence
  Synthetic polynucleotide
cgttgcccaggagctagctg

SEQ ID NO: 8792 - DNA, 20 bp, Artificial Sequence
  Synthetic polynucleotide
cagctccaggtacgtctgtc

SEQ ID NO: 8793 - DNA, 20 bp, Artificial Sequence
  Synthetic polynucleotide
ttgaggtagaaagggaacta

SEQ ID NO: 8794 - DNA, 20 bp, Artificial Sequence
  Synthetic polynucleotide
ggccatgtacagcgagcagc

SEQ ID NO: 8795 - DNA, 20 bp, Artificial Sequence
  Synthetic polynucleotide
ccaggaggtgaggttgcagg

SEQ ID NO: 8796 - DNA, 20 bp, Artificial Sequence
  Synthetic polynucleotide
ctgtctccagcggtgcggtg

SEQ ID NO: 8797 - DNA, 20 bp, Artificial Sequence
  Synthetic polynucleotide
gcacgaagacatcgataata

SEQ ID NO: 8798 - DNA, 20 bp, Artificial Sequence
  Synthetic polynucleotide
gttgaatttccagcttcagg

SEQ ID NO: 8799 - DNA, 20 bp, Artificial Sequence
  Synthetic polynucleotide
gcacggcagcgggccctcag

SEQ ID NO: 8800 - DNA, 20 bp, Artificial Sequence
  Synthetic polynucleotide
agtcattactagggaaggga

SEQ ID NO: 8801 - DNA, 20 bp, Artificial Sequence
  Synthetic polynucleotide
tgactggctggccacggcca

SEQ ID NO: 8802 - DNA, 20 bp, Artificial Sequence
  Synthetic polynucleotide
ctgggatgctgggccccgct

SEQ ID NO: 8803 - DNA, 20 bp, Artificial Sequence
  Synthetic polynucleotide
tcctgctgtccctaggaccc

SEQ ID NO: 8804 - DNA, 20 bp, Artificial Sequence
  Synthetic polynucleotide
cctggtactcctgggtctcc

SEQ ID NO: 8805 - DNA, 20 bp, Artificial Sequence
  Synthetic polynucleotide
aacccactcacacttcacac

SEQ ID NO: 8806 - DNA, 20 bp, Artificial Sequence
  Synthetic polynucleotide
ggtccgggcgtgcgggcgtg

SEQ ID NO: 8807 - DNA, 20 bp, Artificial Sequence
  Synthetic polynucleotide
gcattgcagtgacggatgga

SEQ ID NO: 8808 - DNA, 20 bp, Artificial Sequence
  Synthetic polynucleotide
cactacatcacagaggctgt

SEQ ID NO: 8809 - DNA, 20 bp, Artificial Sequence
  Synthetic polynucleotide
atcgacggcatcggcggcat

SEQ ID NO: 8810 - DNA, 20 bp, Artificial Sequence
  Synthetic polynucleotide
gctccgcgcttgagggcgga

SEQ ID NO: 8811 - DNA, 20 bp, Artificial Sequence
  Synthetic polynucleotide
ctgctcgggccgcgggccgc

SEQ ID NO: 8812 - DNA, 20 bp, Artificial Sequence
  Synthetic polynucleotide
ataccggagccaatggtatc

SEQ ID NO: 8813 - DNA, 20 bp, Artificial Sequence
  Synthetic polynucleotide
aaggggctctgtggacagac

SEQ ID NO: 8814 - DNA, 20 bp, Artificial Sequence
  Synthetic polynucleotide
gacgcgctctcgtaggtggt

SEQ ID NO: 8815 - DNA, 20 bp, Artificial Sequence
  Synthetic polynucleotide
cgactgcaaggacaaatctg

SEQ ID NO: 8816 - DNA, 20 bp, Artificial Sequence
  Synthetic polynucleotide
gcccgggaggcgaacccccc

SEQ ID NO: 8817 - DNA, 20 bp, Artificial Sequence
  Synthetic polynucleotide
gccgcgggagcgagggagcg

SEQ ID NO: 8818 - DNA, 20 bp, Artificial Sequence
  Synthetic polynucleotide
gaggtgggggctggggcgtg

SEQ ID NO: 8819 - DNA, 20 bp, Artificial Sequence
  Synthetic polynucleotide
gccacacgggccttgacgta

SEQ ID NO: 8820 - DNA, 20 bp, Artificial Sequence
  Synthetic polynucleotide
aaggcgctgctgctctgcgc

SEQ ID NO: 8821 - DNA, 20 bp, Artificial Sequence
  Synthetic polynucleotide
cgaaagccggggagtgagtg

SEQ ID NO: 8822 - DNA, 20 bp, Artificial Sequence
  Synthetic polynucleotide
cccggggcccgcgggcccgc

SEQ ID NO: 8823 - DNA, 20 bp, Artificial Sequence
  Synthetic polynucleotide
gggcacacttgaagaaagaa

SEQ ID NO: 8824 - DNA, 20 bp, Artificial Sequence
  Synthetic polynucleotide
cttcggctacagctacagct

SEQ ID NO: 8825 - DNA, 20 bp, Artificial Sequence
  Synthetic polynucleotide
gcgggaccagcaggaccagc

SEQ ID NO: 8826 - DNA, 20 bp, Artificial Sequence
  Synthetic polynucleotide
gacggcgacggtgtagtgga

SEQ ID NO: 8827 - DNA, 20 bp, Artificial Sequence
  Synthetic polynucleotide
gcccatgcaggctgggtggg

SEQ ID NO: 8828 - DNA, 20 bp, Artificial Sequence
  Synthetic polynucleotide
agggcagccaggacgccgcc

SEQ ID NO: 8829 - DNA, 20 bp, Artificial Sequence
  Synthetic polynucleotide
cgggccgtgtgccgccccgc

SEQ ID NO: 8830 - DNA, 20 bp, Artificial Sequence
  Synthetic polynucleotide
ggccccggggcgacgcgacg

SEQ ID NO: 8831 - DNA, 20 bp, Artificial Sequence
  Synthetic polynucleotide
tctccagcccgggtcggcgg

SEQ ID NO: 8832 - DNA, 20 bp, Artificial Sequence
  Synthetic polynucleotide
gcacggctcaggtgccagca

SEQ ID NO: 8833 - DNA, 20 bp, Artificial Sequence
  Synthetic polynucleotide
aagcagaaggcgctgcatgc

SEQ ID NO: 8834 - DNA, 20 bp, Artificial Sequence
  Synthetic polynucleotide
ggtgtggaaggagtcgccgc

SEQ ID NO: 8835 - DNA, 20 bp, Artificial Sequence
  Synthetic polynucleotide
ccggacggcatgctgcttgc

SEQ ID NO: 8836 - DNA, 20 bp, Artificial Sequence
  Synthetic polynucleotide
ccacgtcaacaacggcaact

SEQ ID NO: 8837 - DNA, 20 bp, Artificial Sequence
  Synthetic polynucleotide
tacttacgaactgctgggtt

SEQ ID NO: 8838 - DNA, 20 bp, Artificial Sequence
  Synthetic polynucleotide
cagaggcacttaactaactc

SEQ ID NO: 8839 - DNA, 20 bp, Artificial Sequence
  Synthetic polynucleotide
gcgagcgcaggcggcgcagg

SEQ ID NO: 8840 - DNA, 20 bp, Artificial Sequence
  Synthetic polynucleotide
atgctcaatctgatagaaga

SEQ ID NO: 8841 - DNA, 20 bp, Artificial Sequence
  Synthetic polynucleotide
tctggaacacgtcagcgggc

SEQ ID NO: 8842 - DNA, 20 bp, Artificial Sequence
  Synthetic polynucleotide
ggcaccgcataggggagggg

SEQ ID NO: 8843 - DNA, 20 bp, Artificial Sequence
  Synthetic polynucleotide
ctgcaaggacaaatctgaca

SEQ ID NO: 8844 - DNA, 20 bp, Artificial Sequence
  Synthetic polynucleotide
atcttcgcagtcttcgcagt

SEQ ID NO: 8845 - DNA, 20 bp, Artificial Sequence
  Synthetic polynucleotide
gcagccacagtgtgctgctc

SEQ ID NO: 8846 - DNA, 20 bp, Artificial Sequence
  Synthetic polynucleotide
ggctaggtccaggtgcgtgc

SEQ ID NO: 8847 - DNA, 20 bp, Artificial Sequence
  Synthetic polynucleotide
ggtagctgtggatgcggcgg

SEQ ID NO: 8848 - DNA, 20 bp, Artificial Sequence
  Synthetic polynucleotide
tggctgcgctgggctgcgct

SEQ ID NO: 8849 - DNA, 20 bp, Artificial Sequence
  Synthetic polynucleotide
gtgccggccagccggcccgc

SEQ ID NO: 8850 - DNA, 20 bp, Artificial Sequence
  Synthetic polynucleotide
cactaccccccgcggaagag

SEQ ID NO: 8851 - DNA, 20 bp, Artificial Sequence
  Synthetic polynucleotide
tggggccctgggggaagcct

SEQ ID NO: 8852 - DNA, 20 bp, Artificial Sequence
  Synthetic polynucleotide
acccggggcccgcgggcccg

SEQ ID NO: 8853 - DNA, 20 bp, Artificial Sequence
  Synthetic polynucleotide
tgccctgcctgtgaggggag

SEQ ID NO: 8854 - DNA, 20 bp, Artificial Sequence
  Synthetic polynucleotide
gattcccatcaaacaaacag

SEQ ID NO: 8855 - DNA, 20 bp, Artificial Sequence
  Synthetic polynucleotide
cgccccttggggccaccctg

SEQ ID NO: 8856 - DNA, 20 bp, Artificial Sequence
  Synthetic polynucleotide
actgctcgggccgcgggccg

SEQ ID NO: 8857 - DNA, 20 bp, Artificial Sequence
  Synthetic polynucleotide
aagggcgcactgctgctgct

SEQ ID NO: 8858 - DNA, 20 bp, Artificial Sequence
  Synthetic polynucleotide
cctcgcaggagtctgatgac

SEQ ID NO: 8859 - DNA, 20 bp, Artificial Sequence
  Synthetic polynucleotide
agagaagtctcgagaccacc

SEQ ID NO: 8860 - DNA, 20 bp, Artificial Sequence
  Synthetic polynucleotide
tgcagacgaggacgaggacg

SEQ ID NO: 8861 - DNA, 20 bp, Artificial Sequence
  Synthetic polynucleotide
gccacgccagggtactactg

SEQ ID NO: 8862 - DNA, 20 bp, Artificial Sequence
  Synthetic polynucleotide
ataaacatacggaggagtcg

SEQ ID NO: 8863 - DNA, 20 bp, Artificial Sequence
  Synthetic polynucleotide
tgcggcggctgcggcggctg

SEQ ID NO: 8864 - DNA, 20 bp, Artificial Sequence
  Synthetic polynucleotide
gcgaagatgcgaagatgcga

SEQ ID NO: 8865 - DNA, 20 bp, Artificial Sequence
  Synthetic polynucleotide
ggcccggaacatggacggac

SEQ ID NO: 8866 - DNA, 20 bp, Artificial Sequence
  Synthetic polynucleotide
actttaggcagaggctgggc

SEQ ID NO: 8867 - DNA, 20 bp, Artificial Sequence
  Synthetic polynucleotide
gggccacagagatggcgggc

SEQ ID NO: 8868 - DNA, 20 bp, Artificial Sequence
  Synthetic polynucleotide
cgggctgcccggctcgtccc

SEQ ID NO: 8869 - DNA, 20 bp, Artificial Sequence
  Synthetic polynucleotide
ccctgcggcgctaagtaaga

SEQ ID NO: 8870 - DNA, 20 bp, Artificial Sequence
  Synthetic polynucleotide
gcggggaactggcgcggcgc

SEQ ID NO: 8871 - DNA, 20 bp, Artificial Sequence
  Synthetic polynucleotide
cgctgcgcacgtccggtccg

SEQ ID NO: 8872 - DNA, 20 bp, Artificial Sequence
  Synthetic polynucleotide
gccctccgtcagcagcagca

SEQ ID NO: 8873 - DNA, 20 bp, Artificial Sequence
  Synthetic polynucleotide
agtggcaatggcaatggcaa

SEQ ID NO: 8874 - DNA, 20 bp, Artificial Sequence
  Synthetic polynucleotide
tgctggggatgctgctgctg

SEQ ID NO: 8875 - DNA, 20 bp, Artificial Sequence
  Synthetic polynucleotide
tgacgtgggctgggccgggc

SEQ ID NO: 8876 - DNA, 20 bp, Artificial Sequence
  Synthetic polynucleotide
gacatggctcacacggcaca

SEQ ID NO: 8877 - DNA, 20 bp, Artificial Sequence
  Synthetic polynucleotide
gttatggatgccgaagatga

SEQ ID NO: 8878 - DNA, 20 bp, Artificial Sequence
  Synthetic polynucleotide
ccggcggcggaagctcccgg

SEQ ID NO: 8879 - DNA, 20 bp, Artificial Sequence
  Synthetic polynucleotide
tgacaatggcctggggctga

SEQ ID NO: 8880 - DNA, 20 bp, Artificial Sequence
  Synthetic polynucleotide
ggcgcagcagggccgcagca

SEQ ID NO: 8881 - DNA, 20 bp, Artificial Sequence
  Synthetic polynucleotide
gagagctgcggctgcggctg

SEQ ID NO: 8882 - DNA, 20 bp, Artificial Sequence
  Synthetic polynucleotide
gagctggcccggcggcggcc

SEQ ID NO: 8883 - DNA, 20 bp, Artificial Sequence
  Synthetic polynucleotide
aagttgtccttccgcaggcc

SEQ ID NO: 8884 - DNA, 20 bp, Artificial Sequence
  Synthetic polynucleotide
gggcagagacaggtaggtac

SEQ ID NO: 8885 - DNA, 20 bp, Artificial Sequence
  Synthetic polynucleotide
gcaagctgggcggggggggg

SEQ ID NO: 8886 - DNA, 20 bp, Artificial Sequence
  Synthetic polynucleotide
gtggagtggagcactcactt

SEQ ID NO: 8887 - DNA, 20 bp, Artificial Sequence
  Synthetic polynucleotide
gaggctgtgcgggaaatgtg

SEQ ID NO: 8888 - DNA, 20 bp, Artificial Sequence
  Synthetic polynucleotide
cgttctttggggccatcatc

SEQ ID NO: 8889 - DNA, 20 bp, Artificial Sequence
  Synthetic polynucleotide
gagtgcaggactaaagggta

SEQ ID NO: 8890 - DNA, 20 bp, Artificial Sequence
  Synthetic polynucleotide
atctcatcgtttgcgccgcc

SEQ ID NO: 8891 - DNA, 20 bp, Artificial Sequence
  Synthetic polynucleotide
tcttggacggcggccggccg

SEQ ID NO: 8892 - DNA, 20 bp, Artificial Sequence
  Synthetic polynucleotide
gctggagtgtgaggagtgtg

SEQ ID NO: 8893 - DNA, 20 bp, Artificial Sequence
  Synthetic polynucleotide
ggcaccaagcggtacgtaca

SEQ ID NO: 8894 - DNA, 20 bp, Artificial Sequence
  Synthetic polynucleotide
ggccacttgtgccttgtgcc

SEQ ID NO: 8895 - DNA, 20 bp, Artificial Sequence
  Synthetic polynucleotide
cggtggctgagctggatgga

SEQ ID NO: 8896 - DNA, 20 bp, Artificial Sequence
  Synthetic polynucleotide
tctcggtgatgagcagcagc

SEQ ID NO: 8897 - DNA, 20 bp, Artificial Sequence
  Synthetic polynucleotide
tgtttttatcaacggcaggc

SEQ ID NO: 8898 - DNA, 20 bp, Artificial Sequence
  Synthetic polynucleotide
gcagccaccaagagccggcc

SEQ ID NO: 8899 - DNA, 20 bp, Artificial Sequence
  Synthetic polynucleotide
ggggaggtgtcggccggcct

SEQ ID NO: 8900 - DNA, 20 bp, Artificial Sequence
  Synthetic polynucleotide
ggacggactggtcccccccc

SEQ ID NO: 8901 - DNA, 20 bp, Artificial Sequence
  Synthetic polynucleotide
actactataccggatggata

SEQ ID NO: 8902 - DNA, 20 bp, Artificial Sequence
  Synthetic polynucleotide
ccgggagacggggctggaga

SEQ ID NO: 8903 - DNA, 20 bp, Artificial Sequence
  Synthetic polynucleotide
gcctgggcgcggaggagcgg

SEQ ID NO: 8904 - DNA, 20 bp, Artificial Sequence
  Synthetic polynucleotide
tagaggtcgatggccccgtc

SEQ ID NO: 8905 - DNA, 20 bp, Artificial Sequence
  Synthetic polynucleotide
gccttctaccggaaagatga

SEQ ID NO: 8906 - DNA, 20 bp, Artificial Sequence
  Synthetic polynucleotide
ttgaagtactgggggatgga

SEQ ID NO: 8907 - DNA, 20 bp, Artificial Sequence
  Synthetic polynucleotide
atttcttgccaaggcctgcc

SEQ ID NO: 8908 - DNA, 20 bp, Artificial Sequence
  Synthetic polynucleotide
gtgcccagccagccagccag

SEQ ID NO: 8909 - DNA, 20 bp, Artificial Sequence
  Synthetic polynucleotide
gcagcctggctgccgcagcc

SEQ ID NO: 8910 - DNA, 20 bp, Artificial Sequence
  Synthetic polynucleotide
cgtggaaactgtccacaaca

SEQ ID NO: 8911 - DNA, 20 bp, Artificial Sequence
  Synthetic polynucleotide
tggctacgcaggcaggcagg

SEQ ID NO: 8912 - DNA, 20 bp, Artificial Sequence
  Synthetic polynucleotide
gccactgcccgggaggcatg

SEQ ID NO: 8913 - DNA, 20 bp, Artificial Sequence
  Synthetic polynucleotide
acactctgtgcctgcgtgcg

SEQ ID NO: 8914 - DNA, 20 bp, Artificial Sequence
  Synthetic polynucleotide
cgtgtgcaatacaggtggta

SEQ ID NO: 8915 - DNA, 20 bp, Artificial Sequence
  Synthetic polynucleotide
aggagctgtgcacgacgaca

SEQ ID NO: 8916 - DNA, 20 bp, Artificial Sequence
  Synthetic polynucleotide
gctgcccgcgctgctgctgc

SEQ ID NO: 8917 - DNA, 20 bp, Artificial Sequence
  Synthetic polynucleotide
agccatagctggggcagggc

SEQ ID NO: 8918 - DNA, 20 bp, Artificial Sequence
  Synthetic polynucleotide
tgcgcgcgcgcgccgcgccg

SEQ ID NO: 8919 - DNA, 20 bp, Artificial Sequence
  Synthetic polynucleotide
ccgggtgggcggcccgcccg

SEQ ID NO: 8920 - DNA, 20 bp, Artificial Sequence
  Synthetic polynucleotide
tgtctgcggccgccgtgccg

SEQ ID NO: 8921 - DNA, 20 bp, Artificial Sequence
  Synthetic polynucleotide
gaagatggcggcagcggcag

SEQ ID NO: 8922 - DNA, 20 bp, Artificial Sequence
  Synthetic polynucleotide
gtggctggcgcaggcgggcg

SEQ ID NO: 8923 - DNA, 20 bp, Artificial Sequence
  Synthetic polynucleotide
ggcatcccggggccctggtg

SEQ ID NO: 8924 - DNA, 20 bp, Artificial Sequence
  Synthetic polynucleotide
tttggcaggagctgctgggc

SEQ ID NO: 8925 - DNA, 20 bp, Artificial Sequence
  Synthetic polynucleotide
ccaggtccacgggcagacga

SEQ ID NO: 8926 - DNA, 20 bp, Artificial Sequence
  Synthetic polynucleotide
cagtggctgggctgcgggtc

SEQ ID NO: 8927 - DNA, 20 bp, Artificial Sequence
  Synthetic polynucleotide
tgacacagaaaagagaggag

SEQ ID NO: 8928 - DNA, 20 bp, Artificial Sequence
  Synthetic polynucleotide
cagcaagctgggcggggggg

SEQ ID NO: 8929 - DNA, 20 bp, Artificial Sequence
  Synthetic polynucleotide
cccggtcttgggacggacgc

SEQ ID NO: 8930 - DNA, 20 bp, Artificial Sequence
  Synthetic polynucleotide
tggggccgggccgggccggc

SEQ ID NO: 8931 - DNA, 20 bp, Artificial Sequence
  Synthetic polynucleotide
acactcgcctgtgaagatga

SEQ ID NO: 8932 - DNA, 20 bp, Artificial Sequence
  Synthetic polynucleotide
gctgctgcgcggcggctgcg

SEQ ID NO: 8933 - DNA, 20 bp, Artificial Sequence
  Synthetic polynucleotide
acctactgtccccagaggag

SEQ ID NO: 8934 - DNA, 20 bp, Artificial Sequence
  Synthetic polynucleotide
gtgacaggaggaacggagga

SEQ ID NO: 8935 - DNA, 20 bp, Artificial Sequence
  Synthetic polynucleotide
gagctgccccggagccgccc

SEQ ID NO: 8936 - DNA, 20 bp, Artificial Sequence
  Synthetic polynucleotide
caccgcctgctgctgctgct

SEQ ID NO: 8937 - DNA, 20 bp, Artificial Sequence
  Synthetic polynucleotide
cggcgggccacactctgcct

SEQ ID NO: 8938 - DNA, 20 bp, Artificial Sequence
  Synthetic polynucleotide
acagaatggctcctctcctc

SEQ ID NO: 8939 - DNA, 20 bp, Artificial Sequence
  Synthetic polynucleotide
aactgtgtggtgatgcgacg

SEQ ID NO: 8940 - DNA, 20 bp, Artificial Sequence
  Synthetic polynucleotide
ctgcaggacaacggcaggac

SEQ ID NO: 8941 - DNA, 20 bp, Artificial Sequence
  Synthetic polynucleotide
gctctccacgtcgcccgccc

SEQ ID NO: 8942 - DNA, 20 bp, Artificial Sequence
  Synthetic polynucleotide
gtgggagcaggaggcctgcc

SEQ ID NO: 8943 - DNA, 20 bp, Artificial Sequence
  Synthetic polynucleotide
ctccttccacggcacctgcc

SEQ ID NO: 8944 - DNA, 20 bp, Artificial Sequence
  Synthetic polynucleotide
gcatctacattgacgacgac

SEQ ID NO: 8945 - DNA, 20 bp, Artificial Sequence
  Synthetic polynucleotide
tgcgcataggcctgggccct

SEQ ID NO: 8946 - DNA, 20 bp, Artificial Sequence
  Synthetic polynucleotide
ataggtgttattggaggtgg

SEQ ID NO: 8947 - DNA, 20 bp, Artificial Sequence
  Synthetic polynucleotide
acagcagccgcaggagccgc

SEQ ID NO: 8948 - DNA, 20 bp, Artificial Sequence
  Synthetic polynucleotide
agaagtggcactgcctgccc

SEQ ID NO: 8949 - DNA, 20 bp, Artificial Sequence
  Synthetic polynucleotide
ttgtccttgtggatgggggg

SEQ ID NO: 8950 - DNA, 20 bp, Artificial Sequence
  Synthetic polynucleotide
gaagcctctgggctcgggct

SEQ ID NO: 8951 - DNA, 20 bp, Artificial Sequence
  Synthetic polynucleotide
ggaggcgccgcctgggttgg

SEQ ID NO: 8952 - DNA, 20 bp, Artificial Sequence
  Synthetic polynucleotide
ggcattttatagctgcttgc

SEQ ID NO: 8953 - DNA, 20 bp, Artificial Sequence
  Synthetic polynucleotide
gtgaccgcttgaactggctg

SEQ ID NO: 8954 - DNA, 20 bp, Artificial Sequence
  Synthetic polynucleotide
gtcgccgatgaagagaagaa

SEQ ID NO: 8955 - DNA, 20 bp, Artificial Sequence
  Synthetic polynucleotide
tacctggtgcgggaggaggg

SEQ ID NO: 8956 - DNA, 20 bp, Artificial Sequence
  Synthetic polynucleotide
gtggaatgaggccgaggccg

SEQ ID NO: 8957 - DNA, 20 bp, Artificial Sequence
  Synthetic polynucleotide
ctggtactcctgggtctcct

SEQ ID NO: 8958 - DNA, 20 bp, Artificial Sequence
  Synthetic polynucleotide
tgctcgtggtgatctgctcg

SEQ ID NO: 8959 - DNA, 20 bp, Artificial Sequence
  Synthetic polynucleotide
gttgcgcagccaccggacac

SEQ ID NO: 8960 - DNA, 20 bp, Artificial Sequence
  Synthetic polynucleotide
ccttggtcagcggaggcggg

SEQ ID NO: 8961 - DNA, 20 bp, Artificial Sequence
  Synthetic polynucleotide
gctgctccaggaagtcggct

SEQ ID NO: 8962 - DNA, 20 bp, Artificial Sequence
  Synthetic polynucleotide
gtagcggagggcgcggggcg

SEQ ID NO: 8963 - DNA, 20 bp, Artificial Sequence
  Synthetic polynucleotide
ctttacgtaaatcgtaaatg

SEQ ID NO: 8964 - DNA, 20 bp, Artificial Sequence
  Synthetic polynucleotide
gcgtgggcacgggcagtgag

SEQ ID NO: 8965 - DNA, 20 bp, Artificial Sequence
  Synthetic polynucleotide
taccgaggtgagcagaggca

SEQ ID NO: 8966 - DNA, 20 bp, Artificial Sequence
  Synthetic polynucleotide
tgagcgagcgcaggcagcgc

SEQ ID NO: 8967 - DNA, 20 bp, Artificial Sequence
  Synthetic polynucleotide
gcgctgctgctgctgcttgc

SEQ ID NO: 8968 - DNA, 20 bp, Artificial Sequence
  Synthetic polynucleotide
ccggggtccaggcagcaggc

SEQ ID NO: 8969 - DNA, 20 bp, Artificial Sequence
  Synthetic polynucleotide
tcagactcaggatggatgga

SEQ ID NO: 8970 - DNA, 20 bp, Artificial Sequence
  Synthetic polynucleotide
caggaacagcaggagggagc

SEQ ID NO: 8971 - DNA, 20 bp, Artificial Sequence
  Synthetic polynucleotide
aggatgagatgctgcggcgg

SEQ ID NO: 8972 - DNA, 20 bp, Artificial Sequence
  Synthetic polynucleotide
tgtggagagaaactggtggg

SEQ ID NO: 8973 - DNA, 20 bp, Artificial Sequence
  Synthetic polynucleotide
ctccagcccgggtcggcggg

SEQ ID NO: 8974 - DNA, 20 bp, Artificial Sequence
  Synthetic polynucleotide
tgggcggcggcggcgcggcg

SEQ ID NO: 8975 - DNA, 20 bp, Artificial Sequence
  Synthetic polynucleotide
caggatgccgactggccagc

SEQ ID NO: 8976 - DNA, 20 bp, Artificial Sequence
  Synthetic polynucleotide
cgctcatagagtaaactaac

SEQ ID NO: 8977 - DNA, 20 bp, Artificial Sequence
  Synthetic polynucleotide
ggcaggggacgcccggctcg

SEQ ID NO: 8978 - DNA, 20 bp, Artificial Sequence
  Synthetic polynucleotide
aaggcggaatggtggtggag

SEQ ID NO: 8979 - DNA, 20 bp, Artificial Sequence
  Synthetic polynucleotide
gtatgggcggggccagggcg

SEQ ID NO: 8980 - DNA, 20 bp, Artificial Sequence
  Synthetic polynucleotide
gtggtcggaggagacgtagg

SEQ ID NO: 8981 - DNA, 20 bp, Artificial Sequence
  Synthetic polynucleotide
ggtgggggtgcggcggaggt

SEQ ID NO: 8982 - DNA, 55 bp, Artificial Sequence; identical to SEQ ID NO: 7522
  Synthetic polynucleotide

SEQ ID NO: 8983 - DNA, 55 bp, Artificial Sequence; identical to SEQ ID NO: 7469
  Synthetic polynucleotide

SEQ ID NO: 8984 - DNA, 55 bp, Artificial Sequence; identical to SEQ ID NO: 7950
  Synthetic polynucleotide

SEQ ID NO: 8985 - DNA, 55 bp, Artificial Sequence; identical to SEQ ID NO: 6733
  Synthetic polynucleotide

SEQ ID NO: 8986 - DNA, 55 bp, Artificial Sequence; identical to SEQ ID NO: 7603
  Synthetic polynucleotide

SEQ ID NO: 8987 - DNA, 55 bp, Artificial Sequence; identical to SEQ ID NO: 7266
  Synthetic polynucleotide

SEQ ID NO: 8988 - DNA, 55 bp, Artificial Sequence; identical to SEQ ID NO: 6853
  Synthetic polynucleotide

SEQ ID NO: 8989 - DNA, 55 bp, Artificial Sequence; identical to SEQ ID NO: 7788
  Synthetic polynucleotide

SEQ ID NO: 8990 - DNA, 55 bp, Artificial Sequence; identical to SEQ ID NO: 7437
  Synthetic polynucleotide

SEQ ID NO: 8991 - DNA, 55 bp, Artificial Sequence; identical to SEQ ID NO: 7911
  Synthetic polynucleotide

SEQ ID NO: 8992 - DNA, 55 bp, Artificial Sequence; identical to SEQ ID NO: 6799
  Synthetic polynucleotide

SEQ ID NO: 8993 - DNA, 55 bp, Artificial Sequence; identical to SEQ ID NO: 7932
  Synthetic polynucleotide

SEQ ID NO: 8994 - DNA, 55 bp, Artificial Sequence; identical to SEQ ID NO: 7433
  Synthetic polynucleotide

SEQ ID NO: 8995 - DNA, 55 bp, Artificial Sequence; identical to SEQ ID NO: 6836
  Synthetic polynucleotide

SEQ ID NO: 8996 - DNA, 55 bp, Artificial Sequence; identical to SEQ ID NO: 7781
  Synthetic polynucleotide

SEQ ID NO: 8997 - DNA, 55 bp, Artificial Sequence; identical to SEQ ID NO: 7936
  Synthetic polynucleotide

SEQ ID NO: 8998 - DNA, 55 bp, Artificial Sequence; identical to SEQ ID NO: 8032
  Synthetic polynucleotide

SEQ ID NO: 8999 - DNA, 55 bp, Artificial Sequence; identical to SEQ ID NO: 6823
  Synthetic polynucleotide

SEQ ID NO: 9000 - DNA, 55 bp, Artificial Sequence; identical to SEQ ID NO: 7262
  Synthetic polynucleotide

SEQ ID NO: 9001 - DNA, 55 bp, Artificial Sequence; identical to SEQ ID NO: 8010
  Synthetic polynucleotide

SEQ ID NO: 9002 - DNA, 55 bp, Artificial Sequence; identical to SEQ ID NO: 7984
  Synthetic polynucleotide

SEQ ID NO: 9003 - DNA, 55 bp, Artificial Sequence; identical to SEQ ID NO: 6734
  Synthetic polynucleotide

SEQ ID NO: 9004 - DNA, 55 bp, Artificial Sequence; identical to SEQ ID NO: 7173
  Synthetic polynucleotide

SEQ ID NO: 9005 - DNA, 55 bp, Artificial Sequence; identical to SEQ ID NO: 8059
  Synthetic polynucleotide

SEQ ID NO: 9006 - DNA, 55 bp, Artificial Sequence; identical to SEQ ID NO: 7299
  Synthetic polynucleotide

SEQ ID NO: 9007 - DNA, 55 bp, Artificial Sequence; identical to SEQ ID NO: 6979
  Synthetic polynucleotide

SEQ ID NO: 9008 - DNA, 55 bp, Artificial Sequence; identical to SEQ ID NO: 7370
  Synthetic polynucleotide

SEQ ID NO: 9009 - DNA, 55 bp, Artificial Sequence; identical to SEQ ID NO: 7742
  Synthetic polynucleotide

SEQ ID NO: 9010 - DNA, 55 bp, Artificial Sequence; identical to SEQ ID NO: 8041
  Synthetic polynucleotide

SEQ ID NO: 9011 - DNA, 55 bp, Artificial Sequence; identical to SEQ ID NO: 7345
  Synthetic polynucleotide

SEQ ID NO: 9012 - DNA, 55 bp, Artificial Sequence; identical to SEQ ID NO: 7471
  Synthetic polynucleotide

SEQ ID NO: 9013 - DNA, 55 bp, Artificial Sequence; identical to SEQ ID NO: 7257
  Synthetic polynucleotide

SEQ ID NO: 9014 - DNA, 55 bp, Artificial Sequence; identical to SEQ ID NO: 7107
  Synthetic polynucleotide

SEQ ID NO: 9015 - DNA, 55 bp, Artificial Sequence; identical to SEQ ID NO: 7047
  Synthetic polynucleotide

SEQ ID NO: 9016 - DNA, 55 bp, Artificial Sequence; identical to SEQ ID NO: 7341
  Synthetic polynucleotide

SEQ ID NO: 9017 - DNA, 55 bp, Artificial Sequence; identical to SEQ ID NO: 7930
  Synthetic polynucleotide

SEQ ID NO: 9018 - DNA, 55 bp, Artificial Sequence; identical to SEQ ID NO: 7977
  Synthetic polynucleotide

SEQ ID NO: 9019 - DNA, 55 bp, Artificial Sequence; identical to SEQ ID NO: 8060
  Synthetic polynucleotide

SEQ ID NO: 9020 - DNA, 55 bp, Artificial Sequence; identical to SEQ ID NO: 6817
  Synthetic polynucleotide

SEQ ID NO: 9021 - DNA, 55 bp, Artificial Sequence; identical to SEQ ID NO: 6864
  Synthetic polynucleotide

SEQ ID NO: 9022 - DNA, 55 bp, Artificial Sequence; identical to SEQ ID NO: 8018
  Synthetic polynucleotide

SEQ ID NO: 9023 - DNA, 55 bp, Artificial Sequence; identical to SEQ ID NO: 7910
  Synthetic polynucleotide

SEQ ID NO: 9024 - DNA, 55 bp, Artificial Sequence; identical to SEQ ID NO: 6785
  Synthetic polynucleotide

SEQ ID NO: 9025 - DNA, 55 bp, Artificial Sequence; identical to SEQ ID NO: 6646
  Synthetic polynucleotide

SEQ ID NO: 9026 - DNA, 55 bp, Artificial Sequence; identical to SEQ ID NO: 6641
  Synthetic polynucleotide

SEQ ID NO: 9027 - DNA, 55 bp, Artificial Sequence; identical to SEQ ID NO: 7533
  Synthetic polynucleotide

SEQ ID NO: 9028 - DNA, 55 bp, Artificial Sequence; identical to SEQ ID NO: 6861
  Synthetic polynucleotide

SEQ ID NO: 9029 - DNA, 55 bp, Artificial Sequence; identical to SEQ ID NO: 7315
  Synthetic polynucleotide

SEQ ID NO: 9030 - DNA, 55 bp, Artificial Sequence; identical to SEQ ID NO: 8091
  Synthetic polynucleotide

SEQ ID NO: 9031 - DNA, 55 bp, Artificial Sequence; identical to SEQ ID NO: 7985
  Synthetic polynucleotide

SEQ ID NO: 9032 - DNA, 55 bp, Artificial Sequence; identical to SEQ ID NO: 7188
  Synthetic polynucleotide

SEQ ID NO: 9033 - DNA, 55 bp, Artificial Sequence; identical to SEQ ID NO: 6717
  Synthetic polynucleotide

SEQ ID NO: 9034 - DNA, 55 bp, Artificial Sequence; identical to SEQ ID NO: 6898
  Synthetic polynucleotide

SEQ ID NO: 9035 - DNA, 55 bp, Artificial Sequence; identical to SEQ ID NO: 6988
  Synthetic polynucleotide

SEQ ID NO: 9036 - DNA, 55 bp, Artificial Sequence; identical to SEQ ID NO: 6855
  Synthetic polynucleotide

SEQ ID NO: 9037 - DNA, 55 bp, Artificial Sequence; identical to SEQ ID NO: 7458
  Synthetic polynucleotide

SEQ ID NO: 9038 - DNA, 55 bp, Artificial Sequence; identical to SEQ ID NO: 7317
  Synthetic polynucleotide

SEQ ID NO: 9039 - DNA, 55 bp, Artificial Sequence; identical to SEQ ID NO: 6643
  Synthetic polynucleotide

SEQ ID NO: 9040 - DNA, 55 bp, Artificial Sequence; identical to SEQ ID NO: 7644
  Synthetic polynucleotide

SEQ ID NO: 9041 - DNA, 55 bp, Artificial Sequence; identical to SEQ ID NO: 7752
  Synthetic polynucleotide

SEQ ID NO: 9042 - DNA, 55 bp, Artificial Sequence; identical to SEQ ID NO: 7130
  Synthetic polynucleotide

SEQ ID NO: 9043 - DNA, 55 bp, Artificial Sequence; identical to SEQ ID NO: 7436
  Synthetic polynucleotide

SEQ ID NO: 9044 - DNA, 55 bp, Artificial Sequence; identical to SEQ ID NO: 6697
  Synthetic polynucleotide

SEQ ID NO: 9045 - DNA, 55 bp, Artificial Sequence; identical to SEQ ID NO: 7383
  Synthetic polynucleotide

SEQ ID NO: 9046 - DNA, 55 bp, Artificial Sequence; identical to SEQ ID NO: 7260
  Synthetic polynucleotide

SEQ ID NO: 9047 - DNA, 55 bp, Artificial Sequence; identical to SEQ ID NO: 7726
  Synthetic polynucleotide

SEQ ID NO: 9048 - DNA, 55 bp, Artificial Sequence; identical to SEQ ID NO: 7923
  Synthetic polynucleotide

SEQ ID NO: 9049 - DNA, 55 bp, Artificial Sequence; identical to SEQ ID NO: 8111
  Synthetic polynucleotide

SEQ ID NO: 9050 - DNA, 55 bp, Artificial Sequence; identical to SEQ ID NO: 7117
  Synthetic polynucleotide

SEQ ID NO: 9051 - DNA, 55 bp, Artificial Sequence; identical to SEQ ID NO: 7152
  Synthetic polynucleotide

SEQ ID NO: 9052 - DNA, 55 bp, Artificial Sequence; identical to SEQ ID NO: 7495
  Synthetic polynucleotide

SEQ ID NO: 9053 - DNA, 55 bp, Artificial Sequence; identical to SEQ ID NO: 7229
  Synthetic polynucleotide

SEQ ID NO: 9054 - DNA, 55 bp, Artificial Sequence; identical to SEQ ID NO: 7634
  Synthetic polynucleotide

SEQ ID NO: 9055 - DNA, 55 bp, Artificial Sequence; identical to SEQ ID NO: 7553
  Synthetic polynucleotide

SEQ ID NO: 9056 - DNA, 55 bp, Artificial Sequence; identical to SEQ ID NO: 6876
  Synthetic polynucleotide

SEQ ID NO: 9057 - DNA, 55 bp, Artificial Sequence; identical to SEQ ID NO: 7637
  Synthetic polynucleotide

SEQ ID NO: 9058 - DNA, 55 bp, Artificial Sequence; identical to SEQ ID NO: 7386
  Synthetic polynucleotide

SEQ ID NO: 9059 - DNA, 55 bp, Artificial Sequence; identical to SEQ ID NO: 6995
  Synthetic polynucleotide

SEQ ID NO: 9060 - DNA, 55 bp, Artificial Sequence; identical to SEQ ID NO: 7384
  Synthetic polynucleotide

SEQ ID NO: 9061 - DNA, 55 bp, Artificial Sequence; identical to SEQ ID NO: 8049
  Synthetic polynucleotide

SEQ ID NO: 9062 - DNA, 55 bp, Artificial Sequence; identical to SEQ ID NO: 6625
  Synthetic polynucleotide

SEQ ID NO: 9063 - DNA, 55 bp, Artificial Sequence; identical to SEQ ID NO: 7003
  Synthetic polynucleotide

SEQ ID NO: 9064 - DNA, 55 bp, Artificial Sequence; identical to SEQ ID NO: 7693
  Synthetic polynucleotide

SEQ ID NO: 9065 - DNA, 55 bp, Artificial Sequence; identical to SEQ ID NO: 7645
  Synthetic polynucleotide

SEQ ID NO: 9066 - DNA, 55 bp, Artificial Sequence; identical to SEQ ID NO: 7869
  Synthetic polynucleotide

SEQ ID NO: 9067 - DNA, 55 bp, Artificial Sequence; identical to SEQ ID NO: 6738
  Synthetic polynucleotide

SEQ ID NO: 9068 - DNA, 55 bp, Artificial Sequence; identical to SEQ ID NO: 8000
  Synthetic polynucleotide

SEQ ID NO: 9069 - DNA, 55 bp, Artificial Sequence; identical to SEQ ID NO: 7653
  Synthetic polynucleotide

SEQ ID NO: 9070 - DNA, 55 bp, Artificial Sequence; identical to SEQ ID NO: 6532
  Synthetic polynucleotide

SEQ ID NO: 9071 - DNA, 55 bp, Artificial Sequence; identical to SEQ ID NO: 7953
  Synthetic polynucleotide

SEQ ID NO: 9072 - DNA, 55 bp, Artificial Sequence; identical to SEQ ID NO: 7694
  Synthetic polynucleotide

SEQ ID NO: 9073 - DNA, 55 bp, Artificial Sequence; identical to SEQ ID NO: 7806
  Synthetic polynucleotide

SEQ ID NO: 9074 - DNA, 55 bp, Artificial Sequence; identical to SEQ ID NO: 6745
  Synthetic polynucleotide

SEQ ID NO: 9075 - DNA, 55 bp, Artificial Sequence; identical to SEQ ID NO: 7952
  Synthetic polynucleotide

SEQ ID NO: 9076 - DNA, 55 bp, Artificial Sequence; identical to SEQ ID NO: 6639
  Synthetic polynucleotide

SEQ ID NO: 9077 - DNA, 55 bp, Artificial Sequence; identical to SEQ ID NO: 8034
  Synthetic polynucleotide

SEQ ID NO: 9078 - DNA, 55 bp, Artificial Sequence; identical to SEQ ID NO: 6567
  Synthetic polynucleotide

SEQ ID NO: 9079 - DNA, 55 bp, Artificial Sequence; identical to SEQ ID NO: 6833
  Synthetic polynucleotide

SEQ ID NO: 9080 - DNA, 55 bp, Artificial Sequence; identical to SEQ ID NO: 8044
  Synthetic polynucleotide

SEQ ID NO: 9081 - DNA, 55 bp, Artificial Sequence; identical to SEQ ID NO: 7795
  Synthetic polynucleotide

SEQ ID NO: 9082 - DNA, 55 bp, Artificial Sequence; identical to SEQ ID NO: 7901
  Synthetic polynucleotide

SEQ ID NO: 9083 - DNA, 55 bp, Artificial Sequence; identical to SEQ ID NO: 7969
  Synthetic polynucleotide

SEQ ID NO: 9084 - DNA, 55 bp, Artificial Sequence; identical to SEQ ID NO: 8031
  Synthetic polynucleotide

SEQ ID NO: 9085 - DNA, 55 bp, Artificial Sequence; identical to SEQ ID NO: 7457
  Synthetic polynucleotide

SEQ ID NO: 9086 - DNA, 55 bp, Artificial Sequence; identical to SEQ ID NO: 6778
  Synthetic polynucleotide

SEQ ID NO: 9087 - DNA, 55 bp, Artificial Sequence; identical to SEQ ID NO: 8074
  Synthetic polynucleotide

SEQ ID NO: 9088 - DNA, 55 bp, Artificial Sequence; identical to SEQ ID NO: 7126
  Synthetic polynucleotide

SEQ ID NO: 9089 - DNA, 55 bp, Artificial Sequence; identical to SEQ ID NO: 6776
  Synthetic polynucleotide

SEQ ID NO: 9090 - DNA, 55 bp, Artificial Sequence; identical to SEQ ID NO: 6953
  Synthetic polynucleotide

SEQ ID NO: 9091 - DNA, 55 bp, Artificial Sequence; identical to SEQ ID NO: 7829
  Synthetic polynucleotide

SEQ ID NO: 9092 - DNA, 55 bp, Artificial Sequence; identical to SEQ ID NO: 7015
  Synthetic polynucleotide

SEQ ID NO: 9093 - DNA, 55 bp, Artificial Sequence; identical to SEQ ID NO: 7415
  Synthetic polynucleotide

SEQ ID NO: 9094 - DNA, 55 bp, Artificial Sequence; identical to SEQ ID NO: 7625
  Synthetic polynucleotide

SEQ ID NO: 9095 - DNA, 55 bp, Artificial Sequence; identical to SEQ ID NO: 7897
  Synthetic polynucleotide

SEQ ID NO: 9096 - DNA, 55 bp, Artificial Sequence; identical to SEQ ID NO: 7498
  Synthetic polynucleotide

SEQ ID NO: 9097 - DNA, 55 bp, Artificial Sequence; identical to SEQ ID NO: 6991
  Synthetic polynucleotide

SEQ ID NO: 9098 - DNA, 55 bp, Artificial Sequence; identical to SEQ ID NO: 6894
  Synthetic polynucleotide

SEQ ID NO: 9099 - DNA, 55 bp, Artificial Sequence; identical to SEQ ID NO: 7134
  Synthetic polynucleotide

SEQ ID NO: 9100 - DNA, 55 bp, Artificial Sequence; identical to SEQ ID NO: 6822
  Synthetic polynucleotide

SEQ ID NO: 9101 - DNA, 55 bp, Artificial Sequence; identical to SEQ ID NO: 6931
  Synthetic polynucleotide

SEQ ID NO: 9102 - DNA, 55 bp, Artificial Sequence; identical to SEQ ID NO: 7920
  Synthetic polynucleotide

SEQ ID NO: 9103 - DNA, 55 bp, Artificial Sequence; identical to SEQ ID NO: 7425
  Synthetic polynucleotide

SEQ ID NO: 9104 - DNA, 55 bp, Artificial Sequence; identical to SEQ ID NO: 6918
  Synthetic polynucleotide

SEQ ID NO: 9105 - DNA, 55 bp, Artificial Sequence; identical to SEQ ID NO: 8042
  Synthetic polynucleotide

SEQ ID NO: 9106 - DNA, 55 bp, Artificial Sequence; identical to SEQ ID NO: 7034
  Synthetic polynucleotide

SEQ ID NO: 9107 - DNA, 55 bp, Artificial Sequence; identical to SEQ ID NO: 8086
  Synthetic polynucleotide

SEQ ID NO: 9108 - DNA, 55 bp, Artificial Sequence; identical to SEQ ID NO: 6993
  Synthetic polynucleotide

SEQ ID NO: 9109 - DNA, 55 bp, Artificial Sequence; identical to SEQ ID NO: 7371
  Synthetic polynucleotide

SEQ ID NO: 9110 - DNA, 55 bp, Artificial Sequence; identical to SEQ ID NO: 6537
  Synthetic polynucleotide

SEQ ID NO: 9111 - DNA, 55 bp, Artificial Sequence; identical to SEQ ID NO: 8033
  Synthetic polynucleotide

SEQ ID NO: 9112 - DNA, 55 bp, Artificial Sequence; identical to SEQ ID NO: 7416
  Synthetic polynucleotide

SEQ ID NO: 9113 - DNA, 55 bp, Artificial Sequence; identical to SEQ ID NO: 7161
  Synthetic polynucleotide

SEQ ID NO: 9114 - DNA, 55 bp, Artificial Sequence; identical to SEQ ID NO: 7349
  Synthetic polynucleotide

SEQ ID NO: 9115 - DNA, 55 bp, Artificial Sequence; identical to SEQ ID NO: 7679
  Synthetic polynucleotide

SEQ ID NO: 9116 - DNA, 55 bp, Artificial Sequence; identical to SEQ ID NO: 7898
  Synthetic polynucleotide

SEQ ID NO: 9117 - DNA, 55 bp, Artificial Sequence; identical to SEQ ID NO: 6721
  Synthetic polynucleotide

SEQ ID NO: 9118 - DNA, 55 bp, Artificial Sequence; identical to SEQ ID NO: 7046
  Synthetic polynucleotide

SEQ ID NO: 9119 - DNA, 55 bp, Artificial Sequence; identical to SEQ ID NO: 6701
  Synthetic polynucleotide

SEQ ID NO: 9120 - DNA, 55 bp, Artificial Sequence; identical to SEQ ID NO: 7973
  Synthetic polynucleotide

SEQ ID NO: 9121 - DNA, 55 bp, Artificial Sequence; identical to SEQ ID NO: 7861
  Synthetic polynucleotide

SEQ ID NO: 9122 - DNA, 55 bp, Artificial Sequence; identical to SEQ ID NO: 7387
  Synthetic polynucleotide

SEQ ID NO: 9123 - DNA, 55 bp, Artificial Sequence; identical to SEQ ID NO: 7878
  Synthetic polynucleotide

SEQ ID NO: 9124 - DNA, 55 bp, Artificial Sequence; identical to SEQ ID NO: 7274
  Synthetic polynucleotide

SEQ ID NO: 9125 - DNA, 55 bp, Artificial Sequence; identical to SEQ ID NO: 6682
  Synthetic polynucleotide

SEQ ID NO: 9126 - DNA, 55 bp, Artificial Sequence; identical to SEQ ID NO: 7481
  Synthetic polynucleotide

SEQ ID NO: 9127 - DNA, 55 bp, Artificial Sequence; identical to SEQ ID NO: 7276
  Synthetic polynucleotide

SEQ ID NO: 9128 - DNA, 55 bp, Artificial Sequence; identical to SEQ ID NO: 7404
  Synthetic polynucleotide

SEQ ID NO: 9129 - DNA, 55 bp, Artificial Sequence; identical to SEQ ID NO: 7026
  Synthetic polynucleotide

SEQ ID NO: 9130 - DNA, 55 bp, Artificial Sequence; identical to SEQ ID NO: 7114
  Synthetic polynucleotide

SEQ ID NO: 9131 - DNA, 55 bp, Artificial Sequence; identical to SEQ ID NO: 7766
  Synthetic polynucleotide

SEQ ID NO: 9132 - DNA, 55 bp, Artificial Sequence; identical to SEQ ID NO: 7787
  Synthetic polynucleotide

SEQ ID NO: 9133 - DNA, 55 bp, Artificial Sequence; identical to SEQ ID NO: 6631
  Synthetic polynucleotide

SEQ ID NO: 9134 - DNA, 55 bp, Artificial Sequence; identical to SEQ ID NO: 6858
  Synthetic polynucleotide

SEQ ID NO: 9135 - DNA, 55 bp, Artificial Sequence; identical to SEQ ID NO: 6596
  Synthetic polynucleotide

SEQ ID NO: 9136 - DNA, 55 bp, Artificial Sequence; identical to SEQ ID NO: 7316
  Synthetic polynucleotide

SEQ ID NO: 9137 - DNA, 55 bp, Artificial Sequence; identical to SEQ ID NO: 7169
  Synthetic polynucleotide

SEQ ID NO: 9138 - DNA, 55 bp, Artificial Sequence; identical to SEQ ID NO: 6587
  Synthetic polynucleotide

SEQ ID NO: 9139 - DNA, 55 bp, Artificial Sequence; identical to SEQ ID NO: 7853
  Synthetic polynucleotide

SEQ ID NO: 9140 - DNA, 55 bp, Artificial Sequence; identical to SEQ ID NO: 7926
  Synthetic polynucleotide

SEQ ID NO: 9141 - DNA, 55 bp, Artificial Sequence; identical to SEQ ID NO: 6935
  Synthetic polynucleotide

SEQ ID NO: 9142 - DNA, 55 bp, Artificial Sequence; identical to SEQ ID NO: 7669
  Synthetic polynucleotide

SEQ ID NO: 9143 - DNA, 55 bp, Artificial Sequence; identical to SEQ ID NO: 7978
  Synthetic polynucleotide

SEQ ID NO: 9144 - DNA, 55 bp, Artificial Sequence; identical to SEQ ID NO: 6612
  Synthetic polynucleotide

SEQ ID NO: 9145 - DNA, 55 bp, Artificial Sequence; identical to SEQ ID NO: 8069
  Synthetic polynucleotide

SEQ ID NO: 9146 - DNA, 55 bp, Artificial Sequence; identical to SEQ ID NO: 6990
  Synthetic polynucleotide

SEQ ID NO: 9147 - DNA, 55 bp, Artificial Sequence; identical to SEQ ID NO: 6930
  Synthetic polynucleotide

SEQ ID NO: 9148 - DNA, 55 bp, Artificial Sequence; identical to SEQ ID NO: 7873
  Synthetic polynucleotide

SEQ ID NO: 9149 - DNA, 55 bp, Artificial Sequence; identical to SEQ ID NO: 7942
  Synthetic polynucleotide

SEQ ID NO: 9150 - DNA, 55 bp, Artificial Sequence; identical to SEQ ID NO: 6620
  Synthetic polynucleotide

SEQ ID NO: 9151 - DNA, 55 bp, Artificial Sequence; identical to SEQ ID NO: 6713
  Synthetic polynucleotide

SEQ ID NO: 9152 - DNA, 55 bp, Artificial Sequence; identical to SEQ ID NO: 7777
  Synthetic polynucleotide

SEQ ID NO: 9153 - DNA, 55 bp, Artificial Sequence; identical to SEQ ID NO: 7557
  Synthetic polynucleotide

SEQ ID NO: 9154 - DNA, 55 bp, Artificial Sequence; identical to SEQ ID NO: 7303
  Synthetic polynucleotide

SEQ ID NO: 9155 - DNA, 55 bp, Artificial Sequence; identical to SEQ ID NO: 7432
  Synthetic polynucleotide

SEQ ID NO: 9156 - DNA, 55 bp, Artificial Sequence; identical to SEQ ID NO: 8116
  Synthetic polynucleotide

SEQ ID NO: 9157 - DNA, 55 bp, Artificial Sequence; identical to SEQ ID NO: 7808
  Synthetic polynucleotide

SEQ ID NO: 9158 - DNA, 55 bp, Artificial Sequence; identical to SEQ ID NO: 7665
  Synthetic polynucleotide

SEQ ID NO: 9159 - DNA, 55 bp, Artificial Sequence; identical to SEQ ID NO: 7079
  Synthetic polynucleotide

SEQ ID NO: 9160 - DNA, 55 bp, Artificial Sequence; identical to SEQ ID NO: 7602
  Synthetic polynucleotide

SEQ ID NO: 9161 - DNA, 55 bp, Artificial Sequence; identical to SEQ ID NO: 6714
  Synthetic polynucleotide

SEQ ID NO: 9162 - DNA, 55 bp, Artificial Sequence; identical to SEQ ID NO: 6751
  Synthetic polynucleotide

SEQ ID NO: 9163 - DNA, 55 bp, Artificial Sequence; identical to SEQ ID NO: 6936
  Synthetic polynucleotide

SEQ ID NO: 9164 - DNA, 55 bp, Artificial Sequence; identical to SEQ ID NO: 8088
  Synthetic polynucleotide

SEQ ID NO: 9165 - DNA, 55 bp, Artificial Sequence; identical to SEQ ID NO: 8027
  Synthetic polynucleotide

SEQ ID NO: 9166 - DNA, 55 bp, Artificial Sequence; identical to SEQ ID NO: 7097
  Synthetic polynucleotide

SEQ ID NO: 9167 - DNA, 55 bp, Artificial Sequence; identical to SEQ ID NO: 7253
  Synthetic polynucleotide

SEQ ID NO: 9168 - DNA, 55 bp, Artificial Sequence; identical to SEQ ID NO: 7140
  Synthetic polynucleotide

SEQ ID NO: 9169 - DNA, 55 bp, Artificial Sequence; identical to SEQ ID NO: 7880
  Synthetic polynucleotide

SEQ ID NO: 9170 - DNA, 55 bp, Artificial Sequence; identical to SEQ ID NO: 6768
  Synthetic polynucleotide

SEQ ID NO: 9171 - DNA, 55 bp, Artificial Sequence; identical to SEQ ID NO: 6914
  Synthetic polynucleotide

SEQ ID NO: 9172 - DNA, 55 bp, Artificial Sequence; identical to SEQ ID NO: 7905
  Synthetic polynucleotide

SEQ ID NO: 9173 - DNA, 55 bp, Artificial Sequence; identical to SEQ ID NO: 7980
  Synthetic polynucleotide

SEQ ID NO: 9174 - DNA, 55 bp, Artificial Sequence; identical to SEQ ID NO: 7879
  Synthetic polynucleotide

SEQ ID NO: 9175 - DNA, 55 bp, Artificial Sequence; identical to SEQ ID NO: 7928
  Synthetic polynucleotide

SEQ ID NO: 9176 - DNA, 55 bp, Artificial Sequence; identical to SEQ ID NO: 6565
  Synthetic polynucleotide

SEQ ID NO: 9177 - DNA, 55 bp, Artificial Sequence; identical to SEQ ID NO: 8092
  Synthetic polynucleotide

SEQ ID NO: 9178 - DNA, 55 bp, Artificial Sequence; identical to SEQ ID NO: 7674
  Synthetic polynucleotide

SEQ ID NO: 9179 - DNA, 55 bp, Artificial Sequence; identical to SEQ ID NO: 7967
  Synthetic polynucleotide

SEQ ID NO: 9180 - DNA, 55 bp, Artificial Sequence; identical to SEQ ID NO: 7856
  Synthetic polynucleotide

SEQ ID NO: 9181 - DNA, 55 bp, Artificial Sequence; identical to SEQ ID NO: 7857
  Synthetic polynucleotide

SEQ ID NO: 9182 - DNA, 55 bp, Artificial Sequence; identical to SEQ ID NO: 7649
  Synthetic polynucleotide

SEQ ID NO: 9183 - DNA, 55 bp, Artificial Sequence; identical to SEQ ID NO: 7624
  Synthetic polynucleotide

SEQ ID NO: 9184 - DNA, 55 bp, Artificial Sequence; identical to SEQ ID NO: 8082
  Synthetic polynucleotide

SEQ ID NO: 9185 - DNA, 55 bp, Artificial Sequence; identical to SEQ ID NO: 7486
  Synthetic polynucleotide

SEQ ID NO: 9186 - DNA, 55 bp, Artificial Sequence; identical to SEQ ID NO: 7855
  Synthetic polynucleotide

SEQ ID NO: 9187 - DNA, 55 bp, Artificial Sequence; identical to SEQ ID NO: 7803
  Synthetic polynucleotide

SEQ ID NO: 9188 - DNA, 55 bp, Artificial Sequence; identical to SEQ ID NO: 7678
  Synthetic polynucleotide

SEQ ID NO: 9189 - DNA, 55 bp, Artificial Sequence; identical to SEQ ID NO: 7629
  Synthetic polynucleotide

SEQ ID NO: 9190 - DNA, 55 bp, Artificial Sequence; identical to SEQ ID NO: 7746
  Synthetic polynucleotide

SEQ ID NO: 9191 - DNA, 55 bp, Artificial Sequence; identical to SEQ ID NO: 7238
  Synthetic polynucleotide

SEQ ID NO: 9192 - DNA, 55 bp, Artificial Sequence; identical to SEQ ID NO: 7005
  Synthetic polynucleotide

SEQ ID NO: 9193 - DNA, 55 bp, Artificial Sequence; identical to SEQ ID NO: 7862
  Synthetic polynucleotide

SEQ ID NO: 9194 - DNA, 55 bp, Artificial Sequence; identical to SEQ ID NO: 7124
  Synthetic polynucleotide

SEQ ID NO: 9195 - DNA, 55 bp, Artificial Sequence; identical to SEQ ID NO: 6900
  Synthetic polynucleotide

SEQ ID NO: 9196 - DNA, 55 bp, Artificial Sequence; identical to SEQ ID NO: 7938
  Synthetic polynucleotide

SEQ ID NO: 9197 - DNA, 55 bp, Artificial Sequence; identical to SEQ ID NO: 7975
  Synthetic polynucleotide

SEQ ID NO: 9198 - DNA, 55 bp, Artificial Sequence; identical to SEQ ID NO: 7534
  Synthetic polynucleotide

SEQ ID NO: 9199 - DNA, 55 bp, Artificial Sequence; identical to SEQ ID NO: 8030
  Synthetic polynucleotide

SEQ ID NO: 9200 - DNA, 55 bp, Artificial Sequence; identical to SEQ ID NO: 7802
  Synthetic polynucleotide

SEQ ID NO: 9201 - DNA, 55 bp, Artificial Sequence; identical to SEQ ID NO: 7136
  Synthetic polynucleotide

SEQ ID NO: 9202 - DNA, 55 bp, Artificial Sequence; identical to SEQ ID NO: 7414
  Synthetic polynucleotide

SEQ ID NO: 9203 - DNA, 55 bp, Artificial Sequence; identical to SEQ ID NO: 8087
  Synthetic polynucleotide

SEQ ID NO: 9204 - DNA, 55 bp, Artificial Sequence; identical to SEQ ID NO: 7633
  Synthetic polynucleotide

SEQ ID NO: 9205 - DNA, 55 bp, Artificial Sequence; identical to SEQ ID NO: 7943
  Synthetic polynucleotide

SEQ ID NO: 9206 - DNA, 55 bp, Artificial Sequence; identical to SEQ ID NO: 8058
  Synthetic polynucleotide

SEQ ID NO: 9207 - DNA, 55 bp, Artificial Sequence; identical to SEQ ID NO: 7213
  Synthetic polynucleotide

SEQ ID NO: 9208 - DNA, 55 bp, Artificial Sequence; identical to SEQ ID NO: 7301
  Synthetic polynucleotide

SEQ ID NO: 9209 - DNA, 55 bp, Artificial Sequence; identical to SEQ ID NO: 7411
  Synthetic polynucleotide

SEQ ID NO: 9210 - DNA, 55 bp, Artificial Sequence; identical to SEQ ID NO: 7421
  Synthetic polynucleotide

SEQ ID NO: 9211 - DNA, 55 bp, Artificial Sequence; identical to SEQ ID NO: 7583
  Synthetic polynucleotide

SEQ ID NO: 9212 - DNA, 55 bp, Artificial Sequence; identical to SEQ ID NO: 7994
  Synthetic polynucleotide

SEQ ID NO: 9213 - DNA, 55 bp, Artificial Sequence; identical to SEQ ID NO: 7207
  Synthetic polynucleotide

SEQ ID NO: 9214 - DNA, 55 bp, Artificial Sequence; identical to SEQ ID NO: 7631
  Synthetic polynucleotide

SEQ ID NO: 9215 - DNA, 55 bp, Artificial Sequence; identical to SEQ ID NO: 7212
  Synthetic polynucleotide

SEQ ID NO: 9216 - DNA, 55 bp, Artificial Sequence; identical to SEQ ID NO: 6879
  Synthetic polynucleotide

SEQ ID NO: 9217 - DNA, 55 bp, Artificial Sequence; identical to SEQ ID NO: 6569
  Synthetic polynucleotide

SEQ ID NO: 9218 - DNA, 55 bp, Artificial Sequence; identical to SEQ ID NO: 7972
  Synthetic polynucleotide

SEQ ID NO: 9219 - DNA, 55 bp, Artificial Sequence; identical to SEQ ID NO: 7313
  Synthetic polynucleotide

SEQ ID NO: 9220 - DNA, 55 bp, Artificial Sequence; identical to SEQ ID NO: 7852
  Synthetic polynucleotide

SEQ ID NO: 9221 - DNA, 55 bp, Artificial Sequence; identical to SEQ ID NO: 6795
  Synthetic polynucleotide

SEQ ID NO: 9222 - DNA, 55 bp, Artificial Sequence; identical to SEQ ID NO: 8015
  Synthetic polynucleotide

SEQ ID NO: 9223 - DNA, 55 bp, Artificial Sequence; identical to SEQ ID NO: 7948
  Synthetic polynucleotide

SEQ ID NO: 9224 - DNA, 55 bp, Artificial Sequence; identical to SEQ ID NO: 6662
  Synthetic polynucleotide

SEQ ID NO: 9225 - DNA, 55 bp, Artificial Sequence; identical to SEQ ID NO: 7847
  Synthetic polynucleotide

SEQ ID NO: 9226 - DNA, 55 bp, Artificial Sequence; identical to SEQ ID NO: 7067
  Synthetic polynucleotide

SEQ ID NO: 9227 - DNA, 55 bp, Artificial Sequence; identical to SEQ ID NO: 7555
  Synthetic polynucleotide

SEQ ID NO: 9228 - DNA, 55 bp, Artificial Sequence; identical to SEQ ID NO: 6977
  Synthetic polynucleotide

SEQ ID NO: 9229 - DNA, 55 bp, Artificial Sequence; identical to SEQ ID NO: 7538
  Synthetic polynucleotide

SEQ ID NO: 9230 - DNA, 55 bp, Artificial Sequence; identical to SEQ ID NO: 7043
  Synthetic polynucleotide

SEQ ID NO: 9231 - DNA, 55 bp, Artificial Sequence; identical to SEQ ID NO: 6921
  Synthetic polynucleotide

SEQ ID NO: 9232 - DNA, 55 bp, Artificial Sequence; identical to SEQ ID NO: 7374
  Synthetic polynucleotide

SEQ ID NO: 9233 - DNA, 55 bp, Artificial Sequence; identical to SEQ ID NO: 6622
  Synthetic polynucleotide

SEQ ID NO: 9234 - DNA, 55 bp, Artificial Sequence; identical to SEQ ID NO: 7727
  Synthetic polynucleotide

SEQ ID NO: 9235 - DNA, 55 bp, Artificial Sequence; identical to SEQ ID NO: 7435
  Synthetic polynucleotide

SEQ ID NO: 9236 - DNA, 55 bp, Artificial Sequence; identical to SEQ ID NO: 6838
  Synthetic polynucleotide

SEQ ID NO: 9237 - DNA, 55 bp, Artificial Sequence; identical to SEQ ID NO: 7283
  Synthetic polynucleotide

SEQ ID NO: 9238 - DNA, 55 bp, Artificial Sequence; identical to SEQ ID NO: 7427
  Synthetic polynucleotide

SEQ ID NO: 9239 - DNA, 55 bp, Artificial Sequence; identical to SEQ ID NO: 7929
  Synthetic polynucleotide

SEQ ID NO: 9240 - DNA, 55 bp, Artificial Sequence; identical to SEQ ID NO: 7568
  Synthetic polynucleotide

SEQ ID NO: 9241 - DNA, 55 bp, Artificial Sequence; identical to SEQ ID NO: 7699
  Synthetic polynucleotide

SEQ ID NO: 9242 - DNA, 55 bp, Artificial Sequence; identical to SEQ ID NO: 6851
  Synthetic polynucleotide

SEQ ID NO: 9243 - DNA, 55 bp, Artificial Sequence; identical to SEQ ID NO: 7143
  Synthetic polynucleotide

SEQ ID NO: 9244 - DNA, 55 bp, Artificial Sequence; identical to SEQ ID NO: 6614
  Synthetic polynucleotide

SEQ ID NO: 9245 - DNA, 55 bp, Artificial Sequence; identical to SEQ ID NO: 6736
  Synthetic polynucleotide

SEQ ID NO: 9246 - DNA, 55 bp, Artificial Sequence; identical to SEQ ID NO: 7473
  Synthetic polynucleotide

SEQ ID NO: 9247 - DNA, 55 bp, Artificial Sequence; identical to SEQ ID NO: 7974
  Synthetic polynucleotide

SEQ ID NO: 9248 - DNA, 55 bp, Artificial Sequence; identical to SEQ ID NO: 6551
  Synthetic polynucleotide

SEQ ID NO: 9249 - DNA, 55 bp, Artificial Sequence; identical to SEQ ID NO: 7668
  Synthetic polynucleotide

SEQ ID NO: 9250 - DNA, 55 bp, Artificial Sequence; identical to SEQ ID NO: 7749
  Synthetic polynucleotide

SEQ ID NO: 9251 - DNA, 55 bp, Artificial Sequence; identical to SEQ ID NO: 7449
  Synthetic polynucleotide

SEQ ID NO: 9252 - DNA, 55 bp, Artificial Sequence; identical to SEQ ID NO: 6555
  Synthetic polynucleotide

SEQ ID NO: 9253 - DNA, 55 bp, Artificial Sequence; identical to SEQ ID NO: 8047
  Synthetic polynucleotide

SEQ ID NO: 9254 - DNA, 55 bp, Artificial Sequence; identical to SEQ ID NO: 6982
  Synthetic polynucleotide

SEQ ID NO: 9255 - DNA, 55 bp, Artificial Sequence; identical to SEQ ID NO: 7395
  Synthetic polynucleotide

SEQ ID NO: 9256 - DNA, 55 bp, Artificial Sequence; identical to SEQ ID NO: 8107
  Synthetic polynucleotide

SEQ ID NO: 9257 - DNA, 55 bp, Artificial Sequence; identical to SEQ ID NO: 7323
  Synthetic polynucleotide

SEQ ID NO: 9258 - DNA, 55 bp, Artificial Sequence; identical to SEQ ID NO: 7770
  Synthetic polynucleotide

SEQ ID NO: 9259 - DNA, 55 bp, Artificial Sequence; identical to SEQ ID NO: 7560
  Synthetic polynucleotide

SEQ ID NO: 9260 - DNA, 55 bp, Artificial Sequence; identical to SEQ ID NO: 8093
  Synthetic polynucleotide

SEQ ID NO: 9261 - DNA, 55 bp, Artificial Sequence; identical to SEQ ID NO: 8105
  Synthetic polynucleotide

SEQ ID NO: 9262 - DNA, 55 bp, Artificial Sequence; identical to SEQ ID NO: 7956
  Synthetic polynucleotide

SEQ ID NO: 9263 - DNA, 55 bp, Artificial Sequence; identical to SEQ ID NO: 7366
  Synthetic polynucleotide

SEQ ID NO: 9264 - DNA, 55 bp, Artificial Sequence; identical to SEQ ID NO: 7255
  Synthetic polynucleotide

SEQ ID NO: 9265 - DNA, 55 bp, Artificial Sequence; identical to SEQ ID NO: 7459
  Synthetic polynucleotide

SEQ ID NO: 9266 - DNA, 55 bp, Artificial Sequence; identical to SEQ ID NO: 7614
  Synthetic polynucleotide

SEQ ID NO: 9267 - DNA, 55 bp, Artificial Sequence; identical to SEQ ID NO: 6764
  Synthetic polynucleotide

SEQ ID NO: 9268 - DNA, 55 bp, Artificial Sequence; identical to SEQ ID NO: 6874
  Synthetic polynucleotide

SEQ ID NO: 9269 - DNA, 55 bp, Artificial Sequence; identical to SEQ ID NO: 7243
  Synthetic polynucleotide

SEQ ID NO: 9270 - DNA, 55 bp, Artificial Sequence; identical to SEQ ID NO: 7810
  Synthetic polynucleotide

SEQ ID NO: 9271 - DNA, 55 bp, Artificial Sequence; identical to SEQ ID NO: 7941
  Synthetic polynucleotide

SEQ ID NO: 9272 - DNA, 55 bp, Artificial Sequence; identical to SEQ ID NO: 7413
  Synthetic polynucleotide

SEQ ID NO: 9273 - DNA, 55 bp, Artificial Sequence; identical to SEQ ID NO: 7348
  Synthetic polynucleotide

SEQ ID NO: 9274 - DNA, 55 bp, Artificial Sequence; identical to SEQ ID NO: 8004
  Synthetic polynucleotide

SEQ ID NO: 9275 - DNA, 55 bp, Artificial Sequence; identical to SEQ ID NO: 6961
  Synthetic polynucleotide

SEQ ID NO: 9276 - DNA, 55 bp, Artificial Sequence; identical to SEQ ID NO: 7115
  Synthetic polynucleotide

SEQ ID NO: 9277 - DNA, 55 bp, Artificial Sequence; identical to SEQ ID NO: 7297
  Synthetic polynucleotide

SEQ ID NO: 9278 - DNA, 55 bp, Artificial Sequence; identical to SEQ ID NO: 7049
  Synthetic polynucleotide

SEQ ID NO: 9279 - DNA, 55 bp, Artificial Sequence; identical to SEQ ID NO: 6871
  Synthetic polynucleotide

SEQ ID NO: 9280 - DNA, 55 bp, Artificial Sequence; identical to SEQ ID NO: 7171
  Synthetic polynucleotide

SEQ ID NO: 9281 - DNA, 55 bp, Artificial Sequence; identical to SEQ ID NO: 6577
  Synthetic polynucleotide

SEQ ID NO: 9282 - DNA, 55 bp, Artificial Sequence; identical to SEQ ID NO: 7444
  Synthetic polynucleotide

SEQ ID NO: 9283 - DNA, 55 bp, Artificial Sequence; identical to SEQ ID NO: 8090
  Synthetic polynucleotide

SEQ ID NO: 9284 - DNA, 55 bp, Artificial Sequence; identical to SEQ ID NO: 7006
  Synthetic polynucleotide

SEQ ID NO: 9285 - DNA, 55 bp, Artificial Sequence; identical to SEQ ID NO: 7628
  Synthetic polynucleotide

SEQ ID NO: 9286 - DNA, 55 bp, Artificial Sequence; identical to SEQ ID NO: 7470
  Synthetic polynucleotide

SEQ ID NO: 9287 - DNA, 55 bp, Artificial Sequence; identical to SEQ ID NO: 8055
  Synthetic polynucleotide

SEQ ID NO: 9288 - DNA, 55 bp, Artificial Sequence; identical to SEQ ID NO: 7970
  Synthetic polynucleotide

SEQ ID NO: 9289 - DNA, 55 bp, Artificial Sequence; identical to SEQ ID NO: 7476
  Synthetic polynucleotide

SEQ ID NO: 9290 - DNA, 55 bp, Artificial Sequence; identical to SEQ ID NO: 6805
  Synthetic polynucleotide

SEQ ID NO: 9291 - DNA, 55 bp, Artificial Sequence; identical to SEQ ID NO: 7452
  Synthetic polynucleotide

SEQ ID NO: 9292 - DNA, 55 bp, Artificial Sequence; identical to SEQ ID NO: 6777
  Synthetic polynucleotide

SEQ ID NO: 9293 - DNA, 55 bp, Artificial Sequence; identical to SEQ ID NO: 7646
  Synthetic polynucleotide

SEQ ID NO: 9294 - DNA, 55 bp, Artificial Sequence; identical to SEQ ID NO: 7933
  Synthetic polynucleotide

SEQ ID NO: 9295 - DNA, 55 bp, Artificial Sequence; identical to SEQ ID NO: 7761
  Synthetic polynucleotide

SEQ ID NO: 9296 - DNA, 55 bp, Artificial Sequence; identical to SEQ ID NO: 7196
  Synthetic polynucleotide

SEQ ID NO: 9297 - DNA, 55 bp, Artificial Sequence; identical to SEQ ID NO: 7198
  Synthetic polynucleotide

SEQ ID NO: 9298 - DNA, 55 bp, Artificial Sequence; identical to SEQ ID NO: 6618
  Synthetic polynucleotide

SEQ ID NO: 9299 - DNA, 55 bp, Artificial Sequence; identical to SEQ ID NO: 7663
  Synthetic polynucleotide

SEQ ID NO: 9300 - DNA, 55 bp, Artificial Sequence; identical to SEQ ID NO: 7995
  Synthetic polynucleotide

SEQ ID NO: 9301 - DNA, 55 bp, Artificial Sequence; identical to SEQ ID NO: 6985
  Synthetic polynucleotide

SEQ ID NO: 9302 - DNA, 55 bp, Artificial Sequence; identical to SEQ ID NO: 7595
  Synthetic polynucleotide

SEQ ID NO: 9303 - DNA, 55 bp, Artificial Sequence; identical to SEQ ID NO: 7465
  Synthetic polynucleotide

SEQ ID NO: 9304 - DNA, 55 bp, Artificial Sequence; identical to SEQ ID NO: 7832
  Synthetic polynucleotide

SEQ ID NO: 9305 - DNA, 55 bp, Artificial Sequence; identical to SEQ ID NO: 7278
  Synthetic polynucleotide

SEQ ID NO: 9306 - DNA, 55 bp, Artificial Sequence; identical to SEQ ID NO: 6761
  Synthetic polynucleotide

SEQ ID NO: 9307 - DNA, 55 bp, Artificial Sequence; identical to SEQ ID NO: 6627
  Synthetic polynucleotide

SEQ ID NO: 9308 - DNA, 55 bp, Artificial Sequence; identical to SEQ ID NO: 7696
  Synthetic polynucleotide

SEQ ID NO: 9309 - DNA, 55 bp, Artificial Sequence; identical to SEQ ID NO: 6801
  Synthetic polynucleotide

SEQ ID NO: 9310 - DNA, 55 bp, Artificial Sequence; identical to SEQ ID NO: 7642
  Synthetic polynucleotide

SEQ ID NO: 9311 - DNA, 55 bp, Artificial Sequence; identical to SEQ ID NO: 7767
  Synthetic polynucleotide

SEQ ID NO: 9312 - DNA, 55 bp, Artificial Sequence; identical to SEQ ID NO: 7546
  Synthetic polynucleotide

SEQ ID NO: 9313 - DNA, 55 bp, Artificial Sequence; identical to SEQ ID NO: 6873
  Synthetic polynucleotide

SEQ ID NO: 9314 - DNA, 55 bp, Artificial Sequence; identical to SEQ ID NO: 7851
  Synthetic polynucleotide

SEQ ID NO: 9315 - DNA, 55 bp, Artificial Sequence; identical to SEQ ID NO: 7344
  Synthetic polynucleotide

SEQ ID NO: 9316 - DNA, 55 bp, Artificial Sequence; identical to SEQ ID NO: 7623
  Synthetic polynucleotide

SEQ ID NO: 9317 - DNA, 55 bp, Artificial Sequence; identical to SEQ ID NO: 8008
  Synthetic polynucleotide

SEQ ID NO: 9318 - DNA, 55 bp, Artificial Sequence; identical to SEQ ID NO: 6528
  Synthetic polynucleotide

SEQ ID NO: 9319 - DNA, 55 bp, Artificial Sequence; identical to SEQ ID NO: 7992
  Synthetic polynucleotide

SEQ ID NO: 9320 - DNA, 55 bp, Artificial Sequence; identical to SEQ ID NO: 7431
  Synthetic polynucleotide

SEQ ID NO: 9321 - DNA, 55 bp, Artificial Sequence; identical to SEQ ID NO: 7684
  Synthetic polynucleotide

SEQ ID NO: 9322 - DNA, 55 bp, Artificial Sequence; identical to SEQ ID NO: 6685
  Synthetic polynucleotide

SEQ ID NO: 9323 - DNA, 55 bp, Artificial Sequence; identical to SEQ ID NO: 7521
  Synthetic polynucleotide

SEQ ID NO: 9324 - DNA, 55 bp, Artificial Sequence; identical to SEQ ID NO: 7443
  Synthetic polynucleotide

SEQ ID NO: 9325 - DNA, 55 bp, Artificial Sequence; identical to SEQ ID NO: 7771
  Synthetic polynucleotide

SEQ ID NO: 9326 - DNA, 55 bp, Artificial Sequence; identical to SEQ ID NO: 7756
  Synthetic polynucleotide

SEQ ID NO: 9327 - DNA, 55 bp, Artificial Sequence; identical to SEQ ID NO: 7835
  Synthetic polynucleotide

SEQ ID NO: 9328 - DNA, 55 bp, Artificial Sequence; identical to SEQ ID NO: 6968
  Synthetic polynucleotide

SEQ ID NO: 9329 - DNA, 55 bp, Artificial Sequence; identical to SEQ ID NO: 8077
  Synthetic polynucleotide

SEQ ID NO: 9330 - DNA, 55 bp, Artificial Sequence; identical to SEQ ID NO: 6863
  Synthetic polynucleotide

SEQ ID NO: 9331 - DNA, 55 bp, Artificial Sequence; identical to SEQ ID NO: 7184
  Synthetic polynucleotide

SEQ ID NO: 9332 - DNA, 55 bp, Artificial Sequence; identical to SEQ ID NO: 6629
  Synthetic polynucleotide

SEQ ID NO: 9333 - DNA, 55 bp, Artificial Sequence; identical to SEQ ID NO: 7116
  Synthetic polynucleotide

SEQ ID NO: 9334 - DNA, 55 bp, Artificial Sequence; identical to SEQ ID NO: 7909
  Synthetic polynucleotide

SEQ ID NO: 9335 - DNA, 55 bp, Artificial Sequence; identical to SEQ ID NO: 7513
  Synthetic polynucleotide

SEQ ID NO: 9336 - DNA, 55 bp, Artificial Sequence; identical to SEQ ID NO: 7418
  Synthetic polynucleotide

SEQ ID NO: 9337 - DNA, 55 bp, Artificial Sequence; identical to SEQ ID NO: 7626
  Synthetic polynucleotide

SEQ ID NO: 9338 - DNA, 55 bp, Artificial Sequence; identical to SEQ ID NO: 7217
  Synthetic polynucleotide

SEQ ID NO: 9339 - DNA, 55 bp, Artificial Sequence; identical to SEQ ID NO: 7792
  Synthetic polynucleotide

SEQ ID NO: 9340 - DNA, 55 bp, Artificial Sequence; identical to SEQ ID NO: 7285
  Synthetic polynucleotide

SEQ ID NO: 9341 - DNA, 55 bp, Artificial Sequence; identical to SEQ ID NO: 6647
  Synthetic polynucleotide

SEQ ID NO: 9342 - DNA, 55 bp, Artificial Sequence; identical to SEQ ID NO: 7554
  Synthetic polynucleotide

SEQ ID NO: 9343 - DNA, 55 bp, Artificial Sequence; identical to SEQ ID NO: 6550
  Synthetic polynucleotide

SEQ ID NO: 9344 - DNA, 55 bp, Artificial Sequence; identical to SEQ ID NO: 7511
  Synthetic polynucleotide

SEQ ID NO: 9345 - DNA, 55 bp, Artificial Sequence; identical to SEQ ID NO: 6566
  Synthetic polynucleotide

SEQ ID NO: 9346 - DNA, 55 bp, Artificial Sequence; identical to SEQ ID NO: 7032
  Synthetic polynucleotide

SEQ ID NO: 9347 - DNA, 55 bp, Artificial Sequence; identical to SEQ ID NO: 6759
  Synthetic polynucleotide

SEQ ID NO: 9348 - DNA, 55 bp, Artificial Sequence; identical to SEQ ID NO: 7289
  Synthetic polynucleotide

SEQ ID NO: 9349 - DNA, 55 bp, Artificial Sequence; identical to SEQ ID NO: 6763
  Synthetic polynucleotide

SEQ ID NO: 9350 - DNA, 55 bp, Artificial Sequence; identical to SEQ ID NO: 7535
  Synthetic polynucleotide

SEQ ID NO: 9351 - DNA, 55 bp, Artificial Sequence; identical to SEQ ID NO: 7508
  Synthetic polynucleotide

SEQ ID NO: 9352 - DNA, 55 bp, Artificial Sequence; identical to SEQ ID NO: 6928
  Synthetic polynucleotide

SEQ ID NO: 9353 - DNA, 55 bp, Artificial Sequence; identical to SEQ ID NO: 7090
  Synthetic polynucleotide

SEQ ID NO: 9354 - DNA, 55 bp, Artificial Sequence; identical to SEQ ID NO: 7871
  Synthetic polynucleotide

SEQ ID NO: 9355 - DNA, 55 bp, Artificial Sequence; identical to SEQ ID NO: 7650
  Synthetic polynucleotide

SEQ ID NO: 9356 - DNA, 55 bp, Artificial Sequence; identical to SEQ ID NO: 7627
  Synthetic polynucleotide

SEQ ID NO: 9357 - DNA, 55 bp, Artificial Sequence; identical to SEQ ID NO: 6526
  Synthetic polynucleotide

SEQ ID NO: 9358 - DNA, 55 bp, Artificial Sequence; identical to SEQ ID NO: 7968
  Synthetic polynucleotide

SEQ ID NO: 9359 - DNA, 55 bp, Artificial Sequence; identical to SEQ ID NO: 7091
  Synthetic polynucleotide

SEQ ID NO: 9360 - DNA, 55 bp, Artificial Sequence; identical to SEQ ID NO: 7009
  Synthetic polynucleotide

SEQ ID NO: 9361 - DNA, 55 bp, Artificial Sequence; identical to SEQ ID NO: 7031
  Synthetic polynucleotide

SEQ ID NO: 9362 - DNA, 55 bp, Artificial Sequence; identical to SEQ ID NO: 6605
  Synthetic polynucleotide

SEQ ID NO: 9363 - DNA, 55 bp, Artificial Sequence; identical to SEQ ID NO: 7342
  Synthetic polynucleotide

SEQ ID NO: 9364 - DNA, 55 bp, Artificial Sequence; identical to SEQ ID NO: 7997
  Synthetic polynucleotide

SEQ ID NO: 9365 - DNA, 55 bp, Artificial Sequence; identical to SEQ ID NO: 7902
  Synthetic polynucleotide

SEQ ID NO: 9366 - DNA, 55 bp, Artificial Sequence; identical to SEQ ID NO: 6940
  Synthetic polynucleotide

SEQ ID NO: 9367 - DNA, 55 bp, Artificial Sequence; identical to SEQ ID NO: 7298
  Synthetic polynucleotide

SEQ ID NO: 9368 - DNA, 55 bp, Artificial Sequence; identical to SEQ ID NO: 7845
  Synthetic polynucleotide

SEQ ID NO: 9369 - DNA, 55 bp, Artificial Sequence; identical to SEQ ID NO: 7944
  Synthetic polynucleotide

SEQ ID NO: 9370 - DNA, 55 bp, Artificial Sequence; identical to SEQ ID NO: 8103
  Synthetic polynucleotide

SEQ ID NO: 9371 - DNA, 55 bp, Artificial Sequence; identical to SEQ ID NO: 7868
  Synthetic polynucleotide

SEQ ID NO: 9372 - DNA, 55 bp, Artificial Sequence; identical to SEQ ID NO: 8068
  Synthetic polynucleotide

SEQ ID NO: 9373 - DNA, 55 bp, Artificial Sequence; identical to SEQ ID NO: 7329
  Synthetic polynucleotide

SEQ ID NO: 9374 - DNA, 55 bp, Artificial Sequence; identical to SEQ ID NO: 7860
  Synthetic polynucleotide

SEQ ID NO: 9375 - DNA, 55 bp, Artificial Sequence; identical to SEQ ID NO: 7900
  Synthetic polynucleotide

SEQ ID NO: 9376 - DNA, 55 bp, Artificial Sequence; identical to SEQ ID NO: 7340
  Synthetic polynucleotide

SEQ ID NO: 9377 - DNA, 55 bp, Artificial Sequence; identical to SEQ ID NO: 7870
  Synthetic polynucleotide

SEQ ID NO: 9378 - DNA, 55 bp, Artificial Sequence; identical to SEQ ID NO: 6719
  Synthetic polynucleotide

SEQ ID NO: 9379 - DNA, 55 bp, Artificial Sequence; identical to SEQ ID NO: 6986
  Synthetic polynucleotide

SEQ ID NO: 9380 - DNA, 55 bp, Artificial Sequence; identical to SEQ ID NO: 6652
  Synthetic polynucleotide

SEQ ID NO: 9381 - DNA, 55 bp, Artificial Sequence; identical to SEQ ID NO: 6832
  Synthetic polynucleotide

SEQ ID NO: 9382 - DNA, 55 bp, Artificial Sequence; identical to SEQ ID NO: 7412
  Synthetic polynucleotide

SEQ ID NO: 9383 - DNA, 55 bp, Artificial Sequence; identical to SEQ ID NO: 7714
  Synthetic polynucleotide

SEQ ID NO: 9384 - DNA, 55 bp, Artificial Sequence; identical to SEQ ID NO: 6773
  Synthetic polynucleotide

SEQ ID NO: 9385 - DNA, 55 bp, Artificial Sequence; identical to SEQ ID NO: 7921
  Synthetic polynucleotide

SEQ ID NO: 9386 - DNA, 55 bp, Artificial Sequence; identical to SEQ ID NO: 7347
  Synthetic polynucleotide

SEQ ID NO: 9387 - DNA, 55 bp, Artificial Sequence; identical to SEQ ID NO: 6803
  Synthetic polynucleotide

SEQ ID NO: 9388 - DNA, 55 bp, Artificial Sequence; identical to SEQ ID NO: 6835
  Synthetic polynucleotide

SEQ ID NO: 9389 - DNA, 55 bp, Artificial Sequence; identical to SEQ ID NO: 7962
  Synthetic polynucleotide

SEQ ID NO: 9390 - DNA, 55 bp, Artificial Sequence; identical to SEQ ID NO: 6945
  Synthetic polynucleotide

SEQ ID NO: 9391 - DNA, 55 bp, Artificial Sequence; identical to SEQ ID NO: 7333
  Synthetic polynucleotide

SEQ ID NO: 9392 - DNA, 55 bp, Artificial Sequence; identical to SEQ ID NO: 6684
  Synthetic polynucleotide

SEQ ID NO: 9393 - DNA, 55 bp, Artificial Sequence; identical to SEQ ID NO: 7225
  Synthetic polynucleotide

SEQ ID NO: 9394 - DNA, 55 bp, Artificial Sequence; identical to SEQ ID NO: 7077
  Synthetic polynucleotide

SEQ ID NO: 9395 - DNA, 55 bp, Artificial Sequence; identical to SEQ ID NO: 7991
  Synthetic polynucleotide

SEQ ID NO: 9396 - DNA, 55 bp, Artificial Sequence; identical to SEQ ID NO: 6712
  Synthetic polynucleotide

SEQ ID NO: 9397 - DNA, 55 bp, Artificial Sequence; identical to SEQ ID NO: 7598
  Synthetic polynucleotide

SEQ ID NO: 9398 - DNA, 55 bp, Artificial Sequence; identical to SEQ ID NO: 6548
  Synthetic polynucleotide

SEQ ID NO: 9399 - DNA, 55 bp, Artificial Sequence; identical to SEQ ID NO: 6812
  Synthetic polynucleotide

SEQ ID NO: 9400 - DNA, 55 bp, Artificial Sequence; identical to SEQ ID NO: 7085
  Synthetic polynucleotide

SEQ ID NO: 9401 - DNA, 55 bp, Artificial Sequence; identical to SEQ ID NO: 7818
  Synthetic polynucleotide

SEQ ID NO: 9402 - DNA, 55 bp, Artificial Sequence; identical to SEQ ID NO: 6698
  Synthetic polynucleotide

SEQ ID NO: 9403 - DNA, 55 bp, Artificial Sequence; identical to SEQ ID NO: 7121
  Synthetic polynucleotide

SEQ ID NO: 9404 - DNA, 55 bp, Artificial Sequence; identical to SEQ ID NO: 7410
  Synthetic polynucleotide

SEQ ID NO: 9405 - DNA, 55 bp, Artificial Sequence; identical to SEQ ID NO: 7355
  Synthetic polynucleotide

SEQ ID NO: 9406 - DNA, 55 bp, Artificial Sequence; identical to SEQ ID NO: 7172
  Synthetic polynucleotide

SEQ ID NO: 9407 - DNA, 55 bp, Artificial Sequence; identical to SEQ ID NO: 6956
  Synthetic polynucleotide

SEQ ID NO: 9408 - DNA, 55 bp, Artificial Sequence; identical to SEQ ID NO: 7359
  Synthetic polynucleotide

SEQ ID NO: 9409 - DNA, 55 bp, Artificial Sequence; identical to SEQ ID NO: 8037
  Synthetic polynucleotide

SEQ ID NO: 9410 - DNA, 55 bp, Artificial Sequence; identical to SEQ ID NO: 7474
  Synthetic polynucleotide

SEQ ID NO: 9411 - DNA, 55 bp, Artificial Sequence; identical to SEQ ID NO: 7677
  Synthetic polynucleotide

SEQ ID NO: 9412 - DNA, 55 bp, Artificial Sequence; identical to SEQ ID NO: 7306
  Synthetic polynucleotide

SEQ ID NO: 9413 - DNA, 55 bp, Artificial Sequence; identical to SEQ ID NO: 8096
  Synthetic polynucleotide

SEQ ID NO: 9414 - DNA, 55 bp, Artificial Sequence; identical to SEQ ID NO: 7450
  Synthetic polynucleotide

SEQ ID NO: 9415 - DNA, 55 bp, Artificial Sequence; identical to SEQ ID NO: 7744
  Synthetic polynucleotide

SEQ ID NO: 9416 - DNA, 55 bp, Artificial Sequence; identical to SEQ ID NO: 7250
  Synthetic polynucleotide

SEQ ID NO: 9417 - DNA, 55 bp, Artificial Sequence; identical to SEQ ID NO: 6885
  Synthetic polynucleotide

SEQ ID NO: 9418 - DNA, 55 bp, Artificial Sequence; identical to SEQ ID NO: 7356
  Synthetic polynucleotide

SEQ ID NO: 9419 - DNA, 55 bp, Artificial Sequence; identical to SEQ ID NO: 7430
  Synthetic polynucleotide

SEQ ID NO: 9420 - DNA, 55 bp, Artificial Sequence; identical to SEQ ID NO: 8054
  Synthetic polynucleotide

SEQ ID NO: 9421 - DNA, 55 bp, Artificial Sequence; identical to SEQ ID NO: 7709
  Synthetic polynucleotide

SEQ ID NO: 9422 - DNA, 55 bp, Artificial Sequence; identical to SEQ ID NO: 7133
  Synthetic polynucleotide

SEQ ID NO: 9423 - DNA, 55 bp, Artificial Sequence; identical to SEQ ID NO: 7935
  Synthetic polynucleotide

SEQ ID NO: 9424 - DNA, 55 bp, Artificial Sequence; identical to SEQ ID NO: 7054
  Synthetic polynucleotide

SEQ ID NO: 9425 - DNA, 55 bp, Artificial Sequence; identical to SEQ ID NO: 7640
  Synthetic polynucleotide

SEQ ID NO: 9426 - DNA, 55 bp, Artificial Sequence; identical to SEQ ID NO: 8023
  Synthetic polynucleotide

SEQ ID NO: 9427 - DNA, 55 bp, Artificial Sequence; identical to SEQ ID NO: 6533
  Synthetic polynucleotide

SEQ ID NO: 9428 - DNA, 55 bp, Artificial Sequence; identical to SEQ ID NO: 7673
  Synthetic polynucleotide

SEQ ID NO: 9429 - DNA, 55 bp, Artificial Sequence; identical to SEQ ID NO: 7024
  Synthetic polynucleotide

SEQ ID NO: 9430 - DNA, 55 bp, Artificial Sequence; identical to SEQ ID NO: 7812
  Synthetic polynucleotide

SEQ ID NO: 9431 - DNA, 55 bp, Artificial Sequence; identical to SEQ ID NO: 7334
  Synthetic polynucleotide

SEQ ID NO: 9432 - DNA, 55 bp, Artificial Sequence; identical to SEQ ID NO: 6870
  Synthetic polynucleotide

SEQ ID NO: 9433 - DNA, 55 bp, Artificial Sequence; identical to SEQ ID NO: 7052
  Synthetic polynucleotide

SEQ ID NO: 9434 - DNA, 55 bp, Artificial Sequence; identical to SEQ ID NO: 7081
  Synthetic polynucleotide

SEQ ID NO: 9435 - DNA, 55 bp, Artificial Sequence; identical to SEQ ID NO: 7607
  Synthetic polynucleotide

SEQ ID NO: 9436 - DNA, 55 bp, Artificial Sequence; identical to SEQ ID NO: 6552
  Synthetic polynucleotide

SEQ ID NO: 9437 - DNA, 55 bp, Artificial Sequence; identical to SEQ ID NO: 7892
  Synthetic polynucleotide

SEQ ID NO: 9438 - DNA, 55 bp, Artificial Sequence; identical to SEQ ID NO: 7440
  Synthetic polynucleotide

SEQ ID NO: 9439 - DNA, 55 bp, Artificial Sequence; identical to SEQ ID NO: 7011
  Synthetic polynucleotide

SEQ ID NO: 9440 - DNA, 55 bp, Artificial Sequence; identical to SEQ ID NO: 6992
  Synthetic polynucleotide

SEQ ID NO: 9441 - DNA, 55 bp, Artificial Sequence; identical to SEQ ID NO: 7908
  Synthetic polynucleotide

SEQ ID NO: 9442 - DNA, 55 bp, Artificial Sequence; identical to SEQ ID NO: 7069
  Synthetic polynucleotide

SEQ ID NO: 9443 - DNA, 55 bp, Artificial Sequence; identical to SEQ ID NO: 7725
  Synthetic polynucleotide

SEQ ID NO: 9444 - DNA, 55 bp, Artificial Sequence; identical to SEQ ID NO: 7549
  Synthetic polynucleotide

SEQ ID NO: 9445 - DNA, 55 bp, Artificial Sequence; identical to SEQ ID NO: 7265
  Synthetic polynucleotide

SEQ ID NO: 9446 - DNA, 55 bp, Artificial Sequence; identical to SEQ ID NO: 6867
  Synthetic polynucleotide

SEQ ID NO: 9447 - DNA, 55 bp, Artificial Sequence; identical to SEQ ID NO: 7703
  Synthetic polynucleotide

SEQ ID NO: 9448 - DNA, 55 bp, Artificial Sequence; identical to SEQ ID NO: 6966
  Synthetic polynucleotide

SEQ ID NO: 9449 - DNA, 55 bp, Artificial Sequence; identical to SEQ ID NO: 7990
  Synthetic polynucleotide

SEQ ID NO: 9450 - DNA, 55 bp, Artificial Sequence; identical to SEQ ID NO: 7890
  Synthetic polynucleotide

SEQ ID NO: 9451 - DNA, 55 bp, Artificial Sequence; identical to SEQ ID NO: 7123
  Synthetic polynucleotide

SEQ ID NO: 9452 - DNA, 55 bp, Artificial Sequence; identical to SEQ ID NO: 7050
  Synthetic polynucleotide

SEQ ID NO: 9453 - DNA, 55 bp, Artificial Sequence; identical to SEQ ID NO: 7325
  Synthetic polynucleotide

SEQ ID NO: 9454 - DNA, 55 bp, Artificial Sequence; identical to SEQ ID NO: 7979
  Synthetic polynucleotide

SEQ ID NO: 9455 - DNA, 55 bp, Artificial Sequence; identical to SEQ ID NO: 7659
  Synthetic polynucleotide

SEQ ID NO: 9456 - DNA, 55 bp, Artificial Sequence; identical to SEQ ID NO: 8009
  Synthetic polynucleotide

SEQ ID NO: 9457 - DNA, 55 bp, Artificial Sequence; identical to SEQ ID NO: 6846
  Synthetic polynucleotide

SEQ ID NO: 9458 - DNA, 55 bp, Artificial Sequence; identical to SEQ ID NO: 6585
  Synthetic polynucleotide

SEQ ID NO: 9459 - DNA, 55 bp, Artificial Sequence; identical to SEQ ID NO: 7045
  Synthetic polynucleotide

SEQ ID NO: 9460 - DNA, 55 bp, Artificial Sequence; identical to SEQ ID NO: 7018
  Synthetic polynucleotide

SEQ ID NO: 9461 - DNA, 55 bp, Artificial Sequence; identical to SEQ ID NO: 7472
  Synthetic polynucleotide

SEQ ID NO: 9462 - DNA, 55 bp, Artificial Sequence; identical to SEQ ID NO: 7836
  Synthetic polynucleotide

SEQ ID NO: 9463 - DNA, 55 bp, Artificial Sequence; identical to SEQ ID NO: 6574
  Synthetic polynucleotide

SEQ ID NO: 9464 - DNA, 55 bp, Artificial Sequence; identical to SEQ ID NO: 7565
  Synthetic polynucleotide

SEQ ID NO: 9465 - DNA, 55 bp, Artificial Sequence; identical to SEQ ID NO: 7177
  Synthetic polynucleotide

SEQ ID NO: 9466 - DNA, 55 bp, Artificial Sequence; identical to SEQ ID NO: 7234
  Synthetic polynucleotide

SEQ ID NO: 9467 - DNA, 55 bp, Artificial Sequence; identical to SEQ ID NO: 6623
  Synthetic polynucleotide

SEQ ID NO: 9468 - DNA, 55 bp, Artificial Sequence; identical to SEQ ID NO: 7179
  Synthetic polynucleotide

SEQ ID NO: 9469 - DNA, 55 bp, Artificial Sequence; identical to SEQ ID NO: 6841
  Synthetic polynucleotide

SEQ ID NO: 9470 - DNA, 55 bp, Artificial Sequence; identical to SEQ ID NO: 7772
  Synthetic polynucleotide

SEQ ID NO: 9471 - DNA, 55 bp, Artificial Sequence; identical to SEQ ID NO: 7561
  Synthetic polynucleotide

SEQ ID NO: 9472 - DNA, 55 bp, Artificial Sequence; identical to SEQ ID NO: 7004
  Synthetic polynucleotide

SEQ ID NO: 9473 - DNA, 55 bp, Artificial Sequence; identical to SEQ ID NO: 7676
  Synthetic polynucleotide

SEQ ID NO: 9474 - DNA, 55 bp, Artificial Sequence; identical to SEQ ID NO: 6638
  Synthetic polynucleotide

SEQ ID NO: 9475 - DNA, 55 bp, Artificial Sequence; identical to SEQ ID NO: 6588
  Synthetic polynucleotide

SEQ ID NO: 9476 - DNA, 55 bp, Artificial Sequence; identical to SEQ ID NO: 6965
  Synthetic polynucleotide

SEQ ID NO: 9477 - DNA, 55 bp, Artificial Sequence; identical to SEQ ID NO: 6598
  Synthetic polynucleotide

SEQ ID NO: 9478 - DNA, 55 bp, Artificial Sequence; identical to SEQ ID NO: 7769
  Synthetic polynucleotide

SEQ ID NO: 9479 - DNA, 55 bp, Artificial Sequence; identical to SEQ ID NO: 7547
  Synthetic polynucleotide

SEQ ID NO: 9480 - DNA, 55 bp, Artificial Sequence; identical to SEQ ID NO: 6617
  Synthetic polynucleotide

SEQ ID NO: 9481 - DNA, 55 bp, Artificial Sequence; identical to SEQ ID NO: 6970
  Synthetic polynucleotide

SEQ ID NO: 9482 - DNA, 55 bp, Artificial Sequence; identical to SEQ ID NO: 8040
  Synthetic polynucleotide

SEQ ID NO: 9483 - DNA, 55 bp, Artificial Sequence; identical to SEQ ID NO: 8104
  Synthetic polynucleotide

SEQ ID NO: 9484 - DNA, 55 bp, Artificial Sequence; identical to SEQ ID NO: 8005
  Synthetic polynucleotide

SEQ ID NO: 9485 - DNA, 55 bp, Artificial Sequence; identical to SEQ ID NO: 7876
  Synthetic polynucleotide

SEQ ID NO: 9486 - DNA, 55 bp, Artificial Sequence; identical to SEQ ID NO: 7291
  Synthetic polynucleotide

SEQ ID NO: 9487 - DNA, 55 bp, Artificial Sequence; identical to SEQ ID NO: 7076
  Synthetic polynucleotide

SEQ ID NO: 9488 - DNA, 55 bp, Artificial Sequence; identical to SEQ ID NO: 6960
  Synthetic polynucleotide

SEQ ID NO: 9489 - DNA, 55 bp, Artificial Sequence; identical to SEQ ID NO: 7394
  Synthetic polynucleotide

SEQ ID NO: 9490 - DNA, 55 bp, Artificial Sequence; identical to SEQ ID NO: 7786
  Synthetic polynucleotide

SEQ ID NO: 9491 - DNA, 55 bp, Artificial Sequence; identical to SEQ ID NO: 7375
  Synthetic polynucleotide

SEQ ID NO: 9492 - DNA, 55 bp, Artificial Sequence; identical to SEQ ID NO: 6706
  Synthetic polynucleotide

SEQ ID NO: 9493 - DNA, 55 bp, Artificial Sequence; identical to SEQ ID NO: 7831
  Synthetic polynucleotide

SEQ ID NO: 9494 - DNA, 55 bp, Artificial Sequence; identical to SEQ ID NO: 8076
  Synthetic polynucleotide

SEQ ID NO: 9495 - DNA, 55 bp, Artificial Sequence; identical to SEQ ID NO: 7194
  Synthetic polynucleotide

SEQ ID NO: 9496 - DNA, 55 bp, Artificial Sequence; identical to SEQ ID NO: 6888
  Synthetic polynucleotide

SEQ ID NO: 9497 - DNA, 55 bp, Artificial Sequence; identical to SEQ ID NO: 7318
  Synthetic polynucleotide

SEQ ID NO: 9498 - DNA, 55 bp, Artificial Sequence; identical to SEQ ID NO: 7884
  Synthetic polynucleotide

SEQ ID NO: 9499 - DNA, 55 bp, Artificial Sequence; identical to SEQ ID NO: 7372
  Synthetic polynucleotide

SEQ ID NO: 9500 - DNA, 55 bp, Artificial Sequence; identical to SEQ ID NO: 6727
  Synthetic polynucleotide

SEQ ID NO: 9501 - DNA, 55 bp, Artificial Sequence; identical to SEQ ID NO: 7666
  Synthetic polynucleotide

SEQ ID NO: 9502 - DNA, 55 bp, Artificial Sequence; identical to SEQ ID NO: 6840
  Synthetic polynucleotide

SEQ ID NO: 9503 - DNA, 55 bp, Artificial Sequence; identical to SEQ ID NO: 6821
  Synthetic polynucleotide

SEQ ID NO: 9504 - DNA, 55 bp, Artificial Sequence; identical to SEQ ID NO: 7584
  Synthetic polynucleotide

SEQ ID NO: 9505 - DNA, 55 bp, Artificial Sequence; identical to SEQ ID NO: 7059
  Synthetic polynucleotide

SEQ ID NO: 9506 - DNA, 55 bp, Artificial Sequence; identical to SEQ ID NO: 8003
  Synthetic polynucleotide

SEQ ID NO: 9507 - DNA, 55 bp, Artificial Sequence; identical to SEQ ID NO: 7520
  Synthetic polynucleotide

SEQ ID NO: 9508 - DNA, 55 bp, Artificial Sequence; identical to SEQ ID NO: 7539
  Synthetic polynucleotide

SEQ ID NO: 9509 - DNA, 55 bp, Artificial Sequence; identical to SEQ ID NO: 7922
  Synthetic polynucleotide

SEQ ID NO: 9510 - DNA, 55 bp, Artificial Sequence; identical to SEQ ID NO: 7591
  Synthetic polynucleotide

SEQ ID NO: 9511 - DNA, 55 bp, Artificial Sequence; identical to SEQ ID NO: 7689
  Synthetic polynucleotide

SEQ ID NO: 9512 - DNA, 55 bp, Artificial Sequence; identical to SEQ ID NO: 7872
  Synthetic polynucleotide

SEQ ID NO: 9513 - DNA, 55 bp, Artificial Sequence; identical to SEQ ID NO: 7741
  Synthetic polynucleotide

SEQ ID NO: 9514 - DNA, 55 bp, Artificial Sequence; identical to SEQ ID NO: 7233
  Synthetic polynucleotide

SEQ ID NO: 9515 - DNA, 55 bp, Artificial Sequence; identical to SEQ ID NO: 7635
  Synthetic polynucleotide

SEQ ID NO: 9516 - DNA, 55 bp, Artificial Sequence; identical to SEQ ID NO: 7578
  Synthetic polynucleotide

SEQ ID NO: 9517 - DNA, 55 bp, Artificial Sequence; identical to SEQ ID NO: 7638
  Synthetic polynucleotide

SEQ ID NO: 9518 - DNA, 55 bp, Artificial Sequence; identical to SEQ ID NO: 7791
  Synthetic polynucleotide

SEQ ID NO: 9519 - DNA, 55 bp, Artificial Sequence; identical to SEQ ID NO: 6857
  Synthetic polynucleotide

SEQ ID NO: 9520 - DNA, 55 bp, Artificial Sequence; identical to SEQ ID NO: 7517
  Synthetic polynucleotide

SEQ ID NO: 9521 - DNA, 55 bp, Artificial Sequence; identical to SEQ ID NO: 6558
  Synthetic polynucleotide

SEQ ID NO: 9522 - DNA, 55 bp, Artificial Sequence; identical to SEQ ID NO: 7505
  Synthetic polynucleotide

SEQ ID NO: 9523 - DNA, 55 bp, Artificial Sequence; identical to SEQ ID NO: 6576
  Synthetic polynucleotide

SEQ ID NO: 9524 - DNA, 55 bp, Artificial Sequence; identical to SEQ ID NO: 7185
  Synthetic polynucleotide

SEQ ID NO: 9525 - DNA, 55 bp, Artificial Sequence; identical to SEQ ID NO: 7903
  Synthetic polynucleotide

SEQ ID NO: 9526 - DNA, 55 bp, Artificial Sequence; identical to SEQ ID NO: 6756
  Synthetic polynucleotide

SEQ ID NO: 9527 - DNA, 55 bp, Artificial Sequence; identical to SEQ ID NO: 7500
  Synthetic polynucleotide

SEQ ID NO: 9528 - DNA, 55 bp, Artificial Sequence; identical to SEQ ID NO: 7720
  Synthetic polynucleotide

SEQ ID NO: 9529 - DNA, 55 bp, Artificial Sequence; identical to SEQ ID NO: 7199
  Synthetic polynucleotide

SEQ ID NO: 9530 - DNA, 55 bp, Artificial Sequence; identical to SEQ ID NO: 7402
  Synthetic polynucleotide

SEQ ID NO: 9531 - DNA, 55 bp, Artificial Sequence; identical to SEQ ID NO: 6810
  Synthetic polynucleotide

SEQ ID NO: 9532 - DNA, 55 bp, Artificial Sequence; identical to SEQ ID NO: 7042
  Synthetic polynucleotide

SEQ ID NO: 9533 - DNA, 55 bp, Artificial Sequence; identical to SEQ ID NO: 7270
  Synthetic polynucleotide

SEQ ID NO: 9534 - DNA, 55 bp, Artificial Sequence; identical to SEQ ID NO: 7733
  Synthetic polynucleotide

SEQ ID NO: 9535 - DNA, 55 bp, Artificial Sequence; identical to SEQ ID NO: 6586
  Synthetic polynucleotide

SEQ ID NO: 9536 - DNA, 55 bp, Artificial Sequence; identical to SEQ ID NO: 6974
  Synthetic polynucleotide

SEQ ID NO: 9537 - DNA, 55 bp, Artificial Sequence; identical to SEQ ID NO: 7966
  Synthetic polynucleotide

SEQ ID NO: 9538 - DNA, 55 bp, Artificial Sequence; identical to SEQ ID NO: 6952
  Synthetic polynucleotide

SEQ ID NO: 9539 - DNA, 55 bp, Artificial Sequence; identical to SEQ ID NO: 7574
  Synthetic polynucleotide

SEQ ID NO: 9540 - DNA, 55 bp, Artificial Sequence; identical to SEQ ID NO: 6571
  Synthetic polynucleotide

SEQ ID NO: 9541 - DNA, 55 bp, Artificial Sequence; identical to SEQ ID NO: 7269
  Synthetic polynucleotide

SEQ ID NO: 9542 - DNA, 55 bp, Artificial Sequence; identical to SEQ ID NO: 8064
  Synthetic polynucleotide

SEQ ID NO: 9543 - DNA, 55 bp, Artificial Sequence; identical to SEQ ID NO: 6884
  Synthetic polynucleotide

SEQ ID NO: 9544 - DNA, 55 bp, Artificial Sequence; identical to SEQ ID NO: 6543
  Synthetic polynucleotide

SEQ ID NO: 9545 - DNA, 55 bp, Artificial Sequence; identical to SEQ ID NO: 7881
  Synthetic polynucleotide

SEQ ID NO: 9546 - DNA, 55 bp, Artificial Sequence; identical to SEQ ID NO: 7378
  Synthetic polynucleotide

SEQ ID NO: 9547 - DNA, 55 bp, Artificial Sequence; identical to SEQ ID NO: 7914
  Synthetic polynucleotide

SEQ ID NO: 9548 - DNA, 55 bp, Artificial Sequence; identical to SEQ ID NO: 7987
  Synthetic polynucleotide

SEQ ID NO: 9549 - DNA, 55 bp, Artificial Sequence; identical to SEQ ID NO: 8016
  Synthetic polynucleotide

SEQ ID NO: 9550 - DNA, 55 bp, Artificial Sequence; identical to SEQ ID NO: 7000
  Synthetic polynucleotide

SEQ ID NO: 9551 - DNA, 55 bp, Artificial Sequence; identical to SEQ ID NO: 7639
  Synthetic polynucleotide

SEQ ID NO: 9552 - DNA, 55 bp, Artificial Sequence; identical to SEQ ID NO: 6850
  Synthetic polynucleotide

SEQ ID NO: 9553 - DNA, 55 bp, Artificial Sequence; identical to SEQ ID NO: 7529
  Synthetic polynucleotide

SEQ ID NO: 9554 - DNA, 55 bp, Artificial Sequence; identical to SEQ ID NO: 7904
  Synthetic polynucleotide

SEQ ID NO: 9555 - DNA, 55 bp, Artificial Sequence; identical to SEQ ID NO: 6635
  Synthetic polynucleotide

SEQ ID NO: 9556 - DNA, 55 bp, Artificial Sequence; identical to SEQ ID NO: 6527
  Synthetic polynucleotide

SEQ ID NO: 9557 - DNA, 55 bp, Artificial Sequence; identical to SEQ ID NO: 8062
  Synthetic polynucleotide

SEQ ID NO: 9558 - DNA, 55 bp, Artificial Sequence; identical to SEQ ID NO: 6811
  Synthetic polynucleotide

SEQ ID NO: 9559 - DNA, 55 bp, Artificial Sequence; identical to SEQ ID NO: 7854
  Synthetic polynucleotide

SEQ ID NO: 9560 - DNA, 55 bp, Artificial Sequence; identical to SEQ ID NO: 6929
  Synthetic polynucleotide

SEQ ID NO: 9561 - DNA, 55 bp, Artificial Sequence; identical to SEQ ID NO: 7843
  Synthetic polynucleotide

SEQ ID NO: 9562 - DNA, 55 bp, Artificial Sequence; identical to SEQ ID NO: 6725
  Synthetic polynucleotide

SEQ ID NO: 9563 - DNA, 55 bp, Artificial Sequence; identical to SEQ ID NO: 6731
  Synthetic polynucleotide

SEQ ID NO: 9564 - DNA, 55 bp, Artificial Sequence; identical to SEQ ID NO: 6695
  Synthetic polynucleotide

SEQ ID NO: 9565 - DNA, 55 bp, Artificial Sequence; identical to SEQ ID NO: 6729
  Synthetic polynucleotide

SEQ ID NO: 9566 - DNA, 55 bp, Artificial Sequence; identical to SEQ ID NO: 7886
  Synthetic polynucleotide

SEQ ID NO: 9567 - DNA, 55 bp, Artificial Sequence; identical to SEQ ID NO: 7108
  Synthetic polynucleotide

SEQ ID NO: 9568 - DNA, 55 bp, Artificial Sequence; identical to SEQ ID NO: 7248
  Synthetic polynucleotide

SEQ ID NO: 9569 - DNA, 55 bp, Artificial Sequence; identical to SEQ ID NO: 6815
  Synthetic polynucleotide

SEQ ID NO: 9570 - DNA, 55 bp, Artificial Sequence; identical to SEQ ID NO: 6997
  Synthetic polynucleotide

SEQ ID NO: 9571 - DNA, 55 bp, Artificial Sequence; identical to SEQ ID NO: 7019
  Synthetic polynucleotide

SEQ ID NO: 9572 - DNA, 55 bp, Artificial Sequence; identical to SEQ ID NO: 7468
  Synthetic polynucleotide

SEQ ID NO: 9573 - DNA, 55 bp, Artificial Sequence; identical to SEQ ID NO: 6664
  Synthetic polynucleotide

SEQ ID NO: 9574 - DNA, 55 bp, Artificial Sequence; identical to SEQ ID NO: 7295
  Synthetic polynucleotide

SEQ ID NO: 9575 - DNA, 55 bp, Artificial Sequence; identical to SEQ ID NO: 6942
  Synthetic polynucleotide

SEQ ID NO: 9576 - DNA, 55 bp, Artificial Sequence; identical to SEQ ID NO: 7195
  Synthetic polynucleotide

SEQ ID NO: 9577 - DNA, 55 bp, Artificial Sequence; identical to SEQ ID NO: 7182
  Synthetic polynucleotide

SEQ ID NO: 9578 - DNA, 55 bp, Artificial Sequence; identical to SEQ ID NO: 7305
  Synthetic polynucleotide

SEQ ID NO: 9579 - DNA, 55 bp, Artificial Sequence; identical to SEQ ID NO: 6724
  Synthetic polynucleotide

SEQ ID NO: 9580 - DNA, 55 bp, Artificial Sequence; identical to SEQ ID NO: 7949
  Synthetic polynucleotide

SEQ ID NO: 9581 - DNA, 55 bp, Artificial Sequence; identical to SEQ ID NO: 6954
  Synthetic polynucleotide

SEQ ID NO: 9582 - DNA, 55 bp, Artificial Sequence; identical to SEQ ID NO: 6739
  Synthetic polynucleotide

SEQ ID NO: 9583 - DNA, 55 bp, Artificial Sequence; identical to SEQ ID NO: 6798
  Synthetic polynucleotide

SEQ ID NO: 9584 - DNA, 55 bp, Artificial Sequence; identical to SEQ ID NO: 7671
  Synthetic polynucleotide

SEQ ID NO: 9585 - DNA, 55 bp, Artificial Sequence; identical to SEQ ID NO: 6722
  Synthetic polynucleotide

SEQ ID NO: 9586 - DNA, 55 bp, Artificial Sequence; identical to SEQ ID NO: 7526
  Synthetic polynucleotide

SEQ ID NO: 9587 - DNA, 55 bp, Artificial Sequence; identical to SEQ ID NO: 6887
  Synthetic polynucleotide

SEQ ID NO: 9588 - DNA, 55 bp, Artificial Sequence; identical to SEQ ID NO: 7030
  Synthetic polynucleotide

SEQ ID NO: 9589 - DNA, 55 bp, Artificial Sequence; identical to SEQ ID NO: 7572
  Synthetic polynucleotide

SEQ ID NO: 9590 - DNA, 55 bp, Artificial Sequence; identical to SEQ ID NO: 7830
  Synthetic polynucleotide

SEQ ID NO: 9591 - DNA, 55 bp, Artificial Sequence; identical to SEQ ID NO: 7899
  Synthetic polynucleotide

SEQ ID NO: 9592 - DNA, 55 bp, Artificial Sequence; identical to SEQ ID NO: 7208
  Synthetic polynucleotide

SEQ ID NO: 9593 - DNA, 55 bp, Artificial Sequence; identical to SEQ ID NO: 7254
  Synthetic polynucleotide

SEQ ID NO: 9594 - DNA, 55 bp, Artificial Sequence; identical to SEQ ID NO: 7159
  Synthetic polynucleotide

SEQ ID NO: 9595 - DNA, 55 bp, Artificial Sequence; identical to SEQ ID NO: 7399
  Synthetic polynucleotide

SEQ ID NO: 9596 - DNA, 55 bp, Artificial Sequence; identical to SEQ ID NO: 6937
  Synthetic polynucleotide

SEQ ID NO: 9597 - DNA, 55 bp, Artificial Sequence; identical to SEQ ID NO: 7192
  Synthetic polynucleotide

SEQ ID NO: 9598 - DNA, 55 bp, Artificial Sequence; identical to SEQ ID NO: 7330
  Synthetic polynucleotide

SEQ ID NO: 9599 - DNA, 55 bp, Artificial Sequence; identical to SEQ ID NO: 7205
  Synthetic polynucleotide

SEQ ID NO: 9600 - DNA, 55 bp, Artificial Sequence; identical to SEQ ID NO: 7148
  Synthetic polynucleotide

SEQ ID NO: 9601 - DNA, 55 bp, Artificial Sequence; identical to SEQ ID NO: 6772
  Synthetic polynucleotide

SEQ ID NO: 9602 - DNA, 55 bp, Artificial Sequence; identical to SEQ ID NO: 6608
  Synthetic polynucleotide

SEQ ID NO: 9603 - DNA, 55 bp, Artificial Sequence; identical to SEQ ID NO: 7894
  Synthetic polynucleotide

SEQ ID NO: 9604 - DNA, 55 bp, Artificial Sequence; identical to SEQ ID NO: 8025
  Synthetic polynucleotide

SEQ ID NO: 9605 - DNA, 55 bp, Artificial Sequence; identical to SEQ ID NO: 6741
  Synthetic polynucleotide

SEQ ID NO: 9606 - DNA, 55 bp, Artificial Sequence; identical to SEQ ID NO: 7095
  Synthetic polynucleotide

SEQ ID NO: 9607 - DNA, 55 bp, Artificial Sequence; identical to SEQ ID NO: 6983
  Synthetic polynucleotide

SEQ ID NO: 9608 - DNA, 55 bp, Artificial Sequence; identical to SEQ ID NO: 7976
  Synthetic polynucleotide

SEQ ID NO: 9609 - DNA, 55 bp, Artificial Sequence; identical to SEQ ID NO: 7388
  Synthetic polynucleotide

SEQ ID NO: 9610 - DNA, 55 bp, Artificial Sequence; identical to SEQ ID NO: 7514
  Synthetic polynucleotide

SEQ ID NO: 9611 - DNA, 55 bp, Artificial Sequence; identical to SEQ ID NO: 6771
  Synthetic polynucleotide

SEQ ID NO: 9612 - DNA, 55 bp, Artificial Sequence; identical to SEQ ID NO: 8002
  Synthetic polynucleotide

SEQ ID NO: 9613 - DNA, 55 bp, Artificial Sequence; identical to SEQ ID NO: 6584
  Synthetic polynucleotide

SEQ ID NO: 9614 - DNA, 55 bp, Artificial Sequence; identical to SEQ ID NO: 7813
  Synthetic polynucleotide

SEQ ID NO: 9615 - DNA, 55 bp, Artificial Sequence; identical to SEQ ID NO: 7353
  Synthetic polynucleotide

SEQ ID NO: 9616 - DNA, 55 bp, Artificial Sequence; identical to SEQ ID NO: 7354
  Synthetic polynucleotide

SEQ ID NO: 9617 - DNA, 55 bp, Artificial Sequence; identical to SEQ ID NO: 6901
  Synthetic polynucleotide

SEQ ID NO: 9618 - DNA, 55 bp, Artificial Sequence; identical to SEQ ID NO: 7178
  Synthetic polynucleotide

SEQ ID NO: 9619 - DNA, 55 bp, Artificial Sequence; identical to SEQ ID NO: 7867
  Synthetic polynucleotide

SEQ ID NO: 9620 - DNA, 55 bp, Artificial Sequence; identical to SEQ ID NO: 7585
  Synthetic polynucleotide

SEQ ID NO: 9621 - DNA, 55 bp, Artificial Sequence; identical to SEQ ID NO: 6950
  Synthetic polynucleotide

SEQ ID NO: 9622 - DNA, 55 bp, Artificial Sequence; identical to SEQ ID NO: 7519
  Synthetic polynucleotide

SEQ ID NO: 9623 - DNA, 55 bp, Artificial Sequence; identical to SEQ ID NO: 7611
  Synthetic polynucleotide

SEQ ID NO: 9624 - DNA, 55 bp, Artificial Sequence; identical to SEQ ID NO: 7361
  Synthetic polynucleotide

SEQ ID NO: 9625 - DNA, 55 bp, Artificial Sequence; identical to SEQ ID NO: 6653
  Synthetic polynucleotide

SEQ ID NO: 9626 - DNA, 55 bp, Artificial Sequence; identical to SEQ ID NO: 7201
  Synthetic polynucleotide

SEQ ID NO: 9627 - DNA, 55 bp, Artificial Sequence; identical to SEQ ID NO: 7797
  Synthetic polynucleotide

SEQ ID NO: 9628 - DNA, 55 bp, Artificial Sequence; identical to SEQ ID NO: 8014
  Synthetic polynucleotide

SEQ ID NO: 9629 - DNA, 55 bp, Artificial Sequence; identical to SEQ ID NO: 6926
  Synthetic polynucleotide

SEQ ID NO: 9630 - DNA, 55 bp, Artificial Sequence; identical to SEQ ID NO: 7389
  Synthetic polynucleotide

SEQ ID NO: 9631 - DNA, 55 bp, Artificial Sequence; identical to SEQ ID NO: 6839
  Synthetic polynucleotide

SEQ ID NO: 9632 - DNA, 55 bp, Artificial Sequence; identical to SEQ ID NO: 6862
  Synthetic polynucleotide

SEQ ID NO: 9633 - DNA, 55 bp, Artificial Sequence; identical to SEQ ID NO: 6637
  Synthetic polynucleotide

SEQ ID NO: 9634 - DNA, 55 bp, Artificial Sequence; identical to SEQ ID NO: 7327
  Synthetic polynucleotide

SEQ ID NO: 9635 - DNA, 55 bp, Artificial Sequence; identical to SEQ ID NO: 7146
  Synthetic polynucleotide

SEQ ID NO: 9636 - DNA, 55 bp, Artificial Sequence; identical to SEQ ID NO: 6934
  Synthetic polynucleotide

SEQ ID NO: 9637 - DNA, 55 bp, Artificial Sequence; identical to SEQ ID NO: 6705
  Synthetic polynucleotide

SEQ ID NO: 9638 - DNA, 55 bp, Artificial Sequence; identical to SEQ ID NO: 6687
  Synthetic polynucleotide

SEQ ID NO: 9639 - DNA, 55 bp, Artificial Sequence; identical to SEQ ID NO: 6568
  Synthetic polynucleotide

SEQ ID NO: 9640 - DNA, 55 bp, Artificial Sequence; identical to SEQ ID NO: 7190
  Synthetic polynucleotide

SEQ ID NO: 9641 - DNA, 55 bp, Artificial Sequence; identical to SEQ ID NO: 6590
  Synthetic polynucleotide

SEQ ID NO: 9642 - DNA, 55 bp, Artificial Sequence; identical to SEQ ID NO: 7154
  Synthetic polynucleotide

SEQ ID NO: 9643 - DNA, 55 bp, Artificial Sequence; identical to SEQ ID NO: 7350
  Synthetic polynucleotide

SEQ ID NO: 9644 - DNA, 55 bp, Artificial Sequence; identical to SEQ ID NO: 7660
  Synthetic polynucleotide

SEQ ID NO: 9645 - DNA, 55 bp, Artificial Sequence; identical to SEQ ID NO: 6747
  Synthetic polynucleotide

SEQ ID NO: 9646 - DNA, 55 bp, Artificial Sequence; identical to SEQ ID NO: 7954
  Synthetic polynucleotide

SEQ ID NO: 9647 - DNA, 55 bp, Artificial Sequence; identical to SEQ ID NO: 8038
  Synthetic polynucleotide

SEQ ID NO: 9648 - DNA, 55 bp, Artificial Sequence; identical to SEQ ID NO: 7655
  Synthetic polynucleotide

SEQ ID NO: 9649 - DNA, 55 bp, Artificial Sequence; identical to SEQ ID NO: 7690
  Synthetic polynucleotide

SEQ ID NO: 9650 - DNA, 55 bp, Artificial Sequence; identical to SEQ ID NO: 6749
  Synthetic polynucleotide

SEQ ID NO: 9651 - DNA, 55 bp, Artificial Sequence; identical to SEQ ID NO: 7755
  Synthetic polynucleotide

SEQ ID NO: 9652 - DNA, 55 bp, Artificial Sequence; identical to SEQ ID NO: 8001
  Synthetic polynucleotide

SEQ ID NO: 9653 - DNA, 55 bp, Artificial Sequence; identical to SEQ ID NO: 6909
  Synthetic polynucleotide

SEQ ID NO: 9654 - DNA, 55 bp, Artificial Sequence; identical to SEQ ID NO: 8108
  Synthetic polynucleotide

SEQ ID NO: 9655 - DNA, 55 bp, Artificial Sequence; identical to SEQ ID NO: 6809
  Synthetic polynucleotide

SEQ ID NO: 9656 - DNA, 55 bp, Artificial Sequence; identical to SEQ ID NO: 7579
  Synthetic polynucleotide

SEQ ID NO: 9657 - DNA, 55 bp, Artificial Sequence; identical to SEQ ID NO: 7496
  Synthetic polynucleotide

SEQ ID NO: 9658 - DNA, 55 bp, Artificial Sequence; identical to SEQ ID NO: 7773
  Synthetic polynucleotide

SEQ ID NO: 9659 - DNA, 55 bp, Artificial Sequence; identical to SEQ ID NO: 7588
  Synthetic polynucleotide

SEQ ID NO: 9660 - DNA, 55 bp, Artificial Sequence; identical to SEQ ID NO: 7035
  Synthetic polynucleotide

SEQ ID NO: 9661 - DNA, 55 bp, Artificial Sequence; identical to SEQ ID NO: 7129
  Synthetic polynucleotide

SEQ ID NO: 9662 - DNA, 55 bp, Artificial Sequence; identical to SEQ ID NO: 6889
  Synthetic polynucleotide

SEQ ID NO: 9663 - DNA, 55 bp, Artificial Sequence; identical to SEQ ID NO: 7300
  Synthetic polynucleotide

SEQ ID NO: 9664 - DNA, 55 bp, Artificial Sequence; identical to SEQ ID NO: 7542
  Synthetic polynucleotide

SEQ ID NO: 9665 - DNA, 55 bp, Artificial Sequence; identical to SEQ ID NO: 6553
  Synthetic polynucleotide

SEQ ID NO: 9666 - DNA, 55 bp, Artificial Sequence; identical to SEQ ID NO: 7363
  Synthetic polynucleotide

SEQ ID NO: 9667 - DNA, 55 bp, Artificial Sequence; identical to SEQ ID NO: 6816
  Synthetic polynucleotide

SEQ ID NO: 9668 - DNA, 55 bp, Artificial Sequence; identical to SEQ ID NO: 7098
  Synthetic polynucleotide

SEQ ID NO: 9669 - DNA, 55 bp, Artificial Sequence; identical to SEQ ID NO: 6665
  Synthetic polynucleotide

SEQ ID NO: 9670 - DNA, 55 bp, Artificial Sequence; identical to SEQ ID NO: 7601
  Synthetic polynucleotide

SEQ ID NO: 9671 - DNA, 55 bp, Artificial Sequence; identical to SEQ ID NO: 7219
  Synthetic polynucleotide

SEQ ID NO: 9672 - DNA, 55 bp, Artificial Sequence; identical to SEQ ID NO: 6996
  Synthetic polynucleotide

SEQ ID NO: 9673 - DNA, 55 bp, Artificial Sequence; identical to SEQ ID NO: 6752
  Synthetic polynucleotide

SEQ ID NO: 9674 - DNA, 55 bp, Artificial Sequence; identical to SEQ ID NO: 7620
  Synthetic polynucleotide

SEQ ID NO: 9675 - DNA, 55 bp, Artificial Sequence; identical to SEQ ID NO: 7122
  Synthetic polynucleotide

SEQ ID NO: 9676 - DNA, 55 bp, Artificial Sequence; identical to SEQ ID NO: 7446
  Synthetic polynucleotide

SEQ ID NO: 9677 - DNA, 55 bp, Artificial Sequence; identical to SEQ ID NO: 7798
  Synthetic polynucleotide

SEQ ID NO: 9678 - DNA, 55 bp, Artificial Sequence; identical to SEQ ID NO: 7139
  Synthetic polynucleotide

SEQ ID NO: 9679 - DNA, 55 bp, Artificial Sequence; identical to SEQ ID NO: 6872
  Synthetic polynucleotide

SEQ ID NO: 9680 - DNA, 55 bp, Artificial Sequence; identical to SEQ ID NO: 6691
  Synthetic polynucleotide

SEQ ID NO: 9681 - DNA, 55 bp, Artificial Sequence; identical to SEQ ID NO: 7530
  Synthetic polynucleotide

SEQ ID NO: 9682 - DNA, 55 bp, Artificial Sequence; identical to SEQ ID NO: 7556
  Synthetic polynucleotide

SEQ ID NO: 9683 - DNA, 55 bp, Artificial Sequence; identical to SEQ ID NO: 8046
  Synthetic polynucleotide

SEQ ID NO: 9684 - DNA, 55 bp, Artificial Sequence; identical to SEQ ID NO: 7859
  Synthetic polynucleotide

SEQ ID NO: 9685 - DNA, 55 bp, Artificial Sequence; identical to SEQ ID NO: 7103
  Synthetic polynucleotide

SEQ ID NO: 9686 - DNA, 55 bp, Artificial Sequence; identical to SEQ ID NO: 7013
  Synthetic polynucleotide

SEQ ID NO: 9687 - DNA, 55 bp, Artificial Sequence; identical to SEQ ID NO: 8012
  Synthetic polynucleotide

SEQ ID NO: 9688 - DNA, 55 bp, Artificial Sequence; identical to SEQ ID NO: 6718
  Synthetic polynucleotide

SEQ ID NO: 9689 - DNA, 55 bp, Artificial Sequence; identical to SEQ ID NO: 7150
  Synthetic polynucleotide

SEQ ID NO: 9690 - DNA, 55 bp, Artificial Sequence; identical to SEQ ID NO: 6972
  Synthetic polynucleotide

SEQ ID NO: 9691 - DNA, 55 bp, Artificial Sequence; identical to SEQ ID NO: 6941
  Synthetic polynucleotide

SEQ ID NO: 9692 - DNA, 55 bp, Artificial Sequence; identical to SEQ ID NO: 7687
  Synthetic polynucleotide

SEQ ID NO: 9693 - DNA, 55 bp, Artificial Sequence; identical to SEQ ID NO: 7919
  Synthetic polynucleotide

SEQ ID NO: 9694 - DNA, 55 bp, Artificial Sequence; identical to SEQ ID NO: 7548
  Synthetic polynucleotide

SEQ ID NO: 9695 - DNA, 55 bp, Artificial Sequence; identical to SEQ ID NO: 7224
  Synthetic polynucleotide

SEQ ID NO: 9696 - DNA, 55 bp, Artificial Sequence; identical to SEQ ID NO: 6915
  Synthetic polynucleotide

SEQ ID NO: 9697 - DNA, 55 bp, Artificial Sequence; identical to SEQ ID NO: 7955
  Synthetic polynucleotide

SEQ ID NO: 9698 - DNA, 55 bp, Artificial Sequence; identical to SEQ ID NO: 7328
  Synthetic polynucleotide

SEQ ID NO: 9699 - DNA, 55 bp, Artificial Sequence; identical to SEQ ID NO: 6828
  Synthetic polynucleotide

SEQ ID NO: 9700 - DNA, 55 bp, Artificial Sequence; identical to SEQ ID NO: 6971
  Synthetic polynucleotide

SEQ ID NO: 9701 - DNA, 55 bp, Artificial Sequence; identical to SEQ ID NO: 7816
  Synthetic polynucleotide

SEQ ID NO: 9702 - DNA, 55 bp, Artificial Sequence; identical to SEQ ID NO: 7697
  Synthetic polynucleotide

SEQ ID NO: 9703 - DNA, 55 bp, Artificial Sequence; identical to SEQ ID NO: 7839
  Synthetic polynucleotide

SEQ ID NO: 9704 - DNA, 55 bp, Artificial Sequence; identical to SEQ ID NO: 7509
  Synthetic polynucleotide

SEQ ID NO: 9705 - DNA, 55 bp, Artificial Sequence; identical to SEQ ID NO: 7202
  Synthetic polynucleotide

SEQ ID NO: 9706 - DNA, 55 bp, Artificial Sequence; identical to SEQ ID NO: 6742
  Synthetic polynucleotide

SEQ ID NO: 9707 - DNA, 55 bp, Artificial Sequence; identical to SEQ ID NO: 7099
  Synthetic polynucleotide

SEQ ID NO: 9708 - DNA, 55 bp, Artificial Sequence; identical to SEQ ID NO: 7068
  Synthetic polynucleotide

SEQ ID NO: 9709 - DNA, 55 bp, Artificial Sequence; identical to SEQ ID NO: 6703
  Synthetic polynucleotide

SEQ ID NO: 9710 - DNA, 55 bp, Artificial Sequence; identical to SEQ ID NO: 7467
  Synthetic polynucleotide

SEQ ID NO: 9711 - DNA, 55 bp, Artificial Sequence; identical to SEQ ID NO: 7817
  Synthetic polynucleotide

SEQ ID NO: 9712 - DNA, 55 bp, Artificial Sequence; identical to SEQ ID NO: 7586
  Synthetic polynucleotide

SEQ ID NO: 9713 - DNA, 55 bp, Artificial Sequence; identical to SEQ ID NO: 8066
  Synthetic polynucleotide

SEQ ID NO: 9714 - DNA, 55 bp, Artificial Sequence; identical to SEQ ID NO: 7647
  Synthetic polynucleotide

SEQ ID NO: 9715 - DNA, 55 bp, Artificial Sequence; identical to SEQ ID NO: 7193
  Synthetic polynucleotide

SEQ ID NO: 9716 - DNA, 55 bp, Artificial Sequence; identical to SEQ ID NO: 7112
  Synthetic polynucleotide

SEQ ID NO: 9717 - DNA, 55 bp, Artificial Sequence; identical to SEQ ID NO: 8029
  Synthetic polynucleotide

SEQ ID NO: 9718 - DNA, 55 bp, Artificial Sequence; identical to SEQ ID NO: 6989
  Synthetic polynucleotide

SEQ ID NO: 9719 - DNA, 55 bp, Artificial Sequence; identical to SEQ ID NO: 6800
  Synthetic polynucleotide

SEQ ID NO: 9720 - DNA, 55 bp, Artificial Sequence; identical to SEQ ID NO: 7038
  Synthetic polynucleotide

SEQ ID NO: 9721 - DNA, 55 bp, Artificial Sequence; identical to SEQ ID NO: 7998
  Synthetic polynucleotide

SEQ ID NO: 9722 - DNA, 55 bp, Artificial Sequence; identical to SEQ ID NO: 6923
  Synthetic polynucleotide

SEQ ID NO: 9723 - DNA, 55 bp, Artificial Sequence; identical to SEQ ID NO: 7801
  Synthetic polynucleotide

SEQ ID NO: 9724 - DNA, 55 bp, Artificial Sequence; identical to SEQ ID NO: 7477
  Synthetic polynucleotide

SEQ ID NO: 9725 - DNA, 55 bp, Artificial Sequence; identical to SEQ ID NO: 6676
  Synthetic polynucleotide

SEQ ID NO: 9726 - DNA, 55 bp, Artificial Sequence; identical to SEQ ID NO: 6616
  Synthetic polynucleotide

SEQ ID NO: 9727 - DNA, 55 bp, Artificial Sequence; identical to SEQ ID NO: 6875
  Synthetic polynucleotide

SEQ ID NO: 9728 - DNA, 55 bp, Artificial Sequence; identical to SEQ ID NO: 7734
  Synthetic polynucleotide

SEQ ID NO: 9729 - DNA, 55 bp, Artificial Sequence; identical to SEQ ID NO: 6767
  Synthetic polynucleotide

SEQ ID NO: 9730 - DNA, 55 bp, Artificial Sequence; identical to SEQ ID NO: 6708
  Synthetic polynucleotide

SEQ ID NO: 9731 - DNA, 55 bp, Artificial Sequence; identical to SEQ ID NO: 6951
  Synthetic polynucleotide

SEQ ID NO: 9732 - DNA, 55 bp, Artificial Sequence; identical to SEQ ID NO: 7367
  Synthetic polynucleotide

SEQ ID NO: 9733 - DNA, 55 bp, Artificial Sequence; identical to SEQ ID NO: 7531
  Synthetic polynucleotide

SEQ ID NO: 9734 - DNA, 55 bp, Artificial Sequence; identical to SEQ ID NO: 6671
  Synthetic polynucleotide

SEQ ID NO: 9735 - DNA, 55 bp, Artificial Sequence; identical to SEQ ID NO: 6806
  Synthetic polynucleotide

SEQ ID NO: 9736 - DNA, 55 bp, Artificial Sequence; identical to SEQ ID NO: 7462
  Synthetic polynucleotide

SEQ ID NO: 9737 - DNA, 55 bp, Artificial Sequence; identical to SEQ ID NO: 6593
  Synthetic polynucleotide

SEQ ID NO: 9738 - DNA, 55 bp, Artificial Sequence; identical to SEQ ID NO: 6580
  Synthetic polynucleotide

SEQ ID NO: 9739 - DNA, 55 bp, Artificial Sequence; identical to SEQ ID NO: 7636
  Synthetic polynucleotide

SEQ ID NO: 9740 - DNA, 55 bp, Artificial Sequence; identical to SEQ ID NO: 7896
  Synthetic polynucleotide

SEQ ID NO: 9741 - DNA, 55 bp, Artificial Sequence; identical to SEQ ID NO: 6779
  Synthetic polynucleotide

SEQ ID NO: 9742 - DNA, 55 bp, Artificial Sequence; identical to SEQ ID NO: 7596
  Synthetic polynucleotide

SEQ ID NO: 9743 - DNA, 55 bp, Artificial Sequence; identical to SEQ ID NO: 6603
  Synthetic polynucleotide

SEQ ID NO: 9744 - DNA, 55 bp, Artificial Sequence; identical to SEQ ID NO: 7848
  Synthetic polynucleotide

SEQ ID NO: 9745 - DNA, 55 bp, Artificial Sequence; identical to SEQ ID NO: 8024
  Synthetic polynucleotide

SEQ ID NO: 9746 - DNA, 55 bp, Artificial Sequence; identical to SEQ ID NO: 6669
  Synthetic polynucleotide

SEQ ID NO: 9747 - DNA, 55 bp, Artificial Sequence; identical to SEQ ID NO: 6644
  Synthetic polynucleotide

SEQ ID NO: 9748 - DNA, 55 bp, Artificial Sequence; identical to SEQ ID NO: 7369
  Synthetic polynucleotide

SEQ ID NO: 9749 - DNA, 55 bp, Artificial Sequence; identical to SEQ ID NO: 7523
  Synthetic polynucleotide

SEQ ID NO: 9750 - DNA, 55 bp, Artificial Sequence; identical to SEQ ID NO: 7376
  Synthetic polynucleotide

SEQ ID NO: 9751 - DNA, 55 bp, Artificial Sequence; identical to SEQ ID NO: 7451
  Synthetic polynucleotide

SEQ ID NO: 9752 - DNA, 55 bp, Artificial Sequence; identical to SEQ ID NO: 7407
  Synthetic polynucleotide

SEQ ID NO: 9753 - DNA, 55 bp, Artificial Sequence; identical to SEQ ID NO: 7396
  Synthetic polynucleotide

SEQ ID NO: 9754 - DNA, 55 bp, Artificial Sequence; identical to SEQ ID NO: 7566
  Synthetic polynucleotide

SEQ ID NO: 9755 - DNA, 55 bp, Artificial Sequence; identical to SEQ ID NO: 7408
  Synthetic polynucleotide

SEQ ID NO: 9756 - DNA, 55 bp, Artificial Sequence; identical to SEQ ID NO: 6882
  Synthetic polynucleotide

SEQ ID NO: 9757 - DNA, 55 bp, Artificial Sequence; identical to SEQ ID NO: 6561
  Synthetic polynucleotide

SEQ ID NO: 9758 - DNA, 55 bp, Artificial Sequence; identical to SEQ ID NO: 7479
  Synthetic polynucleotide

SEQ ID NO: 9759 - DNA, 55 bp, Artificial Sequence; identical to SEQ ID NO: 7488
  Synthetic polynucleotide

SEQ ID NO: 9760 - DNA, 55 bp, Artificial Sequence; identical to SEQ ID NO: 6780
  Synthetic polynucleotide

SEQ ID NO: 9761 - DNA, 55 bp, Artificial Sequence; identical to SEQ ID NO: 6640
  Synthetic polynucleotide

SEQ ID NO: 9762 - DNA, 55 bp, Artificial Sequence; identical to SEQ ID NO: 7768
  Synthetic polynucleotide

SEQ ID NO: 9763 - DNA, 55 bp, Artificial Sequence; identical to SEQ ID NO: 7821
  Synthetic polynucleotide

SEQ ID NO: 9764 - DNA, 55 bp, Artificial Sequence; identical to SEQ ID NO: 7482
  Synthetic polynucleotide

SEQ ID NO: 9765 - DNA, 55 bp, Artificial Sequence; identical to SEQ ID NO: 7842
  Synthetic polynucleotide

SEQ ID NO: 9766 - DNA, 55 bp, Artificial Sequence; identical to SEQ ID NO: 7084
  Synthetic polynucleotide

SEQ ID NO: 9767 - DNA, 55 bp, Artificial Sequence; identical to SEQ ID NO: 7247
  Synthetic polynucleotide

SEQ ID NO: 9768 - DNA, 55 bp, Artificial Sequence; identical to SEQ ID NO: 7478
  Synthetic polynucleotide

SEQ ID NO: 9769 - DNA, 55 bp, Artificial Sequence; identical to SEQ ID NO: 8065
  Synthetic polynucleotide

SEQ ID NO: 9770 - DNA, 55 bp, Artificial Sequence; identical to SEQ ID NO: 6845
  Synthetic polynucleotide

SEQ ID NO: 9771 - DNA, 55 bp, Artificial Sequence; identical to SEQ ID NO: 7242
  Synthetic polynucleotide

SEQ ID NO: 9772 - DNA, 55 bp, Artificial Sequence; identical to SEQ ID NO: 7397
  Synthetic polynucleotide

SEQ ID NO: 9773 - DNA, 55 bp, Artificial Sequence; identical to SEQ ID NO: 6591
  Synthetic polynucleotide

SEQ ID NO: 9774 - DNA, 55 bp, Artificial Sequence; identical to SEQ ID NO: 6910
  Synthetic polynucleotide

SEQ ID NO: 9775 - DNA, 55 bp, Artificial Sequence; identical to SEQ ID NO: 7664
  Synthetic polynucleotide

SEQ ID NO: 9776 - DNA, 55 bp, Artificial Sequence; identical to SEQ ID NO: 7385
  Synthetic polynucleotide

SEQ ID NO: 9777 - DNA, 55 bp, Artificial Sequence; identical to SEQ ID NO: 7503
  Synthetic polynucleotide

SEQ ID NO: 9778 - DNA, 55 bp, Artificial Sequence; identical to SEQ ID NO: 7764
  Synthetic polynucleotide

SEQ ID NO: 9779 - DNA, 55 bp, Artificial Sequence; identical to SEQ ID NO: 6792
  Synthetic polynucleotide

SEQ ID NO: 9780 - DNA, 55 bp, Artificial Sequence; identical to SEQ ID NO: 6619
  Synthetic polynucleotide

SEQ ID NO: 9781 - DNA, 55 bp, Artificial Sequence; identical to SEQ ID NO: 6924
  Synthetic polynucleotide

SEQ ID NO: 9782 - DNA, 55 bp, Artificial Sequence; identical to SEQ ID NO: 7448
  Synthetic polynucleotide

SEQ ID NO: 9783 - DNA, 55 bp, Artificial Sequence; identical to SEQ ID NO: 7223
  Synthetic polynucleotide

SEQ ID NO: 9784 - DNA, 55 bp, Artificial Sequence; identical to SEQ ID NO: 7434
  Synthetic polynucleotide

SEQ ID NO: 9785 - DNA, 55 bp, Artificial Sequence; identical to SEQ ID NO: 7461
  Synthetic polynucleotide

SEQ ID NO: 9786 - DNA, 55 bp, Artificial Sequence; identical to SEQ ID NO: 6578
  Synthetic polynucleotide

SEQ ID NO: 9787 - DNA, 55 bp, Artificial Sequence; identical to SEQ ID NO: 7110
  Synthetic polynucleotide

SEQ ID NO: 9788 - DNA, 55 bp, Artificial Sequence; identical to SEQ ID NO: 7965
  Synthetic polynucleotide

SEQ ID NO: 9789 - DNA, 55 bp, Artificial Sequence; identical to SEQ ID NO: 6980
  Synthetic polynucleotide

SEQ ID NO: 9790 - DNA, 55 bp, Artificial Sequence; identical to SEQ ID NO: 7757
  Synthetic polynucleotide

SEQ ID NO: 9791 - DNA, 55 bp, Artificial Sequence; identical to SEQ ID NO: 6842
  Synthetic polynucleotide

SEQ ID NO: 9792 - DNA, 55 bp, Artificial Sequence; identical to SEQ ID NO: 6531
  Synthetic polynucleotide

SEQ ID NO: 9793 - DNA, 55 bp, Artificial Sequence; identical to SEQ ID NO: 7765
  Synthetic polynucleotide

SEQ ID NO: 9794 - DNA, 55 bp, Artificial Sequence; identical to SEQ ID NO: 7400
  Synthetic polynucleotide

SEQ ID NO: 9795 - DNA, 55 bp, Artificial Sequence; identical to SEQ ID NO: 6994
  Synthetic polynucleotide

SEQ ID NO: 9796 - DNA, 55 bp, Artificial Sequence; identical to SEQ ID NO: 7849
  Synthetic polynucleotide

SEQ ID NO: 9797 - DNA, 55 bp, Artificial Sequence; identical to SEQ ID NO: 7667
  Synthetic polynucleotide

SEQ ID NO: 9798 - DNA, 55 bp, Artificial Sequence; identical to SEQ ID NO: 7100
  Synthetic polynucleotide

SEQ ID NO: 9799 - DNA, 55 bp, Artificial Sequence; identical to SEQ ID NO: 7001
  Synthetic polynucleotide

SEQ ID NO: 9800 - DNA, 55 bp, Artificial Sequence; identical to SEQ ID NO: 7222
  Synthetic polynucleotide

SEQ ID NO: 9801 - DNA, 55 bp, Artificial Sequence; identical to SEQ ID NO: 7494
  Synthetic polynucleotide

SEQ ID NO: 9802 - DNA, 55 bp, Artificial Sequence; identical to SEQ ID NO: 7087
  Synthetic polynucleotide

SEQ ID NO: 9803 - DNA, 55 bp, Artificial Sequence; identical to SEQ ID NO: 7392
  Synthetic polynucleotide

SEQ ID NO: 9804 - DNA, 55 bp, Artificial Sequence; identical to SEQ ID NO: 7382
  Synthetic polynucleotide

SEQ ID NO: 9805 - DNA, 55 bp, Artificial Sequence; identical to SEQ ID NO: 6829
  Synthetic polynucleotide

SEQ ID NO: 9806 - DNA, 55 bp, Artificial Sequence; identical to SEQ ID NO: 7545
  Synthetic polynucleotide

SEQ ID NO: 9807 - DNA, 55 bp, Artificial Sequence; identical to SEQ ID NO: 6880
  Synthetic polynucleotide

SEQ ID NO: 9808 - DNA, 55 bp, Artificial Sequence; identical to SEQ ID NO: 7215
  Synthetic polynucleotide

SEQ ID NO: 9809 - DNA, 55 bp, Artificial Sequence; identical to SEQ ID NO: 7616
  Synthetic polynucleotide

SEQ ID NO: 9810 - DNA, 55 bp, Artificial Sequence; identical to SEQ ID NO: 7056
  Synthetic polynucleotide

SEQ ID NO: 9811 - DNA, 55 bp, Artificial Sequence; identical to SEQ ID NO: 7600
  Synthetic polynucleotide

SEQ ID NO: 9812 - DNA, 55 bp, Artificial Sequence; identical to SEQ ID NO: 8017
  Synthetic polynucleotide

SEQ ID NO: 9813 - DNA, 55 bp, Artificial Sequence; identical to SEQ ID NO: 7512
  Synthetic polynucleotide

SEQ ID NO: 9814 - DNA, 55 bp, Artificial Sequence; identical to SEQ ID NO: 7428
  Synthetic polynucleotide

SEQ ID NO: 9815 - DNA, 55 bp, Artificial Sequence; identical to SEQ ID NO: 6849
  Synthetic polynucleotide

SEQ ID NO: 9816 - DNA, 55 bp, Artificial Sequence; identical to SEQ ID NO: 7695
  Synthetic polynucleotide

SEQ ID NO: 9817 - DNA, 55 bp, Artificial Sequence; identical to SEQ ID NO: 7662
  Synthetic polynucleotide

SEQ ID NO: 9818 - DNA, 55 bp, Artificial Sequence; identical to SEQ ID NO: 6680
  Synthetic polynucleotide

SEQ ID NO: 9819 - DNA, 55 bp, Artificial Sequence; identical to SEQ ID NO: 7544
  Synthetic polynucleotide

SEQ ID NO: 9820 - DNA, 55 bp, Artificial Sequence; identical to SEQ ID NO: 6944
  Synthetic polynucleotide

SEQ ID NO: 9821 - DNA, 55 bp, Artificial Sequence; identical to SEQ ID NO: 7483
  Synthetic polynucleotide

SEQ ID NO: 9822 - DNA, 55 bp, Artificial Sequence; identical to SEQ ID NO: 7877
  Synthetic polynucleotide

SEQ ID NO: 9823 - DNA, 55 bp, Artificial Sequence; identical to SEQ ID NO: 7758
  Synthetic polynucleotide

SEQ ID NO: 9824 - DNA, 55 bp, Artificial Sequence; identical to SEQ ID NO: 6843
  Synthetic polynucleotide

SEQ ID NO: 9825 - DNA, 55 bp, Artificial Sequence; identical to SEQ ID NO: 7456
  Synthetic polynucleotide

SEQ ID NO: 9826 - DNA, 55 bp, Artificial Sequence; identical to SEQ ID NO: 6999
  Synthetic polynucleotide

SEQ ID NO: 9827 - DNA, 55 bp, Artificial Sequence; identical to SEQ ID NO: 8115
  Synthetic polynucleotide

SEQ ID NO: 9828 - DNA, 55 bp, Artificial Sequence; identical to SEQ ID NO: 7167
  Synthetic polynucleotide

SEQ ID NO: 9829 - DNA, 55 bp, Artificial Sequence; identical to SEQ ID NO: 7805
  Synthetic polynucleotide

SEQ ID NO: 9830 - DNA, 55 bp, Artificial Sequence; identical to SEQ ID NO: 7730
  Synthetic polynucleotide

SEQ ID NO: 9831 - DNA, 55 bp, Artificial Sequence; identical to SEQ ID NO: 7267
  Synthetic polynucleotide

SEQ ID NO: 9832 - DNA, 55 bp, Artificial Sequence; identical to SEQ ID NO: 7040
  Synthetic polynucleotide

SEQ ID NO: 9833 - DNA, 55 bp, Artificial Sequence; identical to SEQ ID NO: 7127
  Synthetic polynucleotide

SEQ ID NO: 9834 - DNA, 55 bp, Artificial Sequence; identical to SEQ ID NO: 6895
  Synthetic polynucleotide

SEQ ID NO: 9835 - DNA, 55 bp, Artificial Sequence; identical to SEQ ID NO: 7132
  Synthetic polynucleotide

SEQ ID NO: 9836 - DNA, 55 bp, Artificial Sequence; identical to SEQ ID NO: 7652
  Synthetic polynucleotide

SEQ ID NO: 9837 - DNA, 55 bp, Artificial Sequence; identical to SEQ ID NO: 7779
  Synthetic polynucleotide

SEQ ID NO: 9838 - DNA, 55 bp, Artificial Sequence; identical to SEQ ID NO: 7475
  Synthetic polynucleotide

SEQ ID NO: 9839 - DNA, 55 bp, Artificial Sequence; identical to SEQ ID NO: 7162
  Synthetic polynucleotide

SEQ ID NO: 9840 - DNA, 55 bp, Artificial Sequence; identical to SEQ ID NO: 7261
  Synthetic polynucleotide

SEQ ID NO: 9841 - DNA, 55 bp, Artificial Sequence; identical to SEQ ID NO: 7246
  Synthetic polynucleotide

SEQ ID NO: 9842 - DNA, 55 bp, Artificial Sequence; identical to SEQ ID NO: 6609
  Synthetic polynucleotide

SEQ ID NO: 9843 - DNA, 55 bp, Artificial Sequence; identical to SEQ ID NO: 7109
  Synthetic polynucleotide

SEQ ID NO: 9844 - DNA, 55 bp, Artificial Sequence; identical to SEQ ID NO: 7391
  Synthetic polynucleotide

SEQ ID NO: 9845 - DNA, 55 bp, Artificial Sequence; identical to SEQ ID NO: 7811
  Synthetic polynucleotide

SEQ ID NO: 9846 - DNA, 55 bp, Artificial Sequence; identical to SEQ ID NO: 7939
  Synthetic polynucleotide

SEQ ID NO: 9847 - DNA, 219 bp, Artificial Sequence
  Synthetic polynucleotide
ggagtggggaggggtatcttgggcctagctaagttgtgtttttctttttcatttcacagggtccttctggtcctgttggtcctgctggtgctgttggccctgctggtgctgttggcccaagaggtcctagtgtatgtacatgctgaagatttctttgcaacactaacatttagagagaatcagtccaaaacatctgttaagaaaataaacaatatatca

SEQ ID NO: 9848 - DNA, 218 bp, Artificial Sequence
  Synthetic polynucleotide
gcctcgtacgggccgtacacacgcgtgcagagcatggcgctgccccccggcgtagtgaactcgtacaatggcctgggaggcccgccggccgcacccccgccccggccgcacccccgcctccgccgcacccccacccgcatccgcacgcacaccatctgcacgcggccgccgcaccgccgcctgccccaccgcaccacggggccgccgcgccgccgccg

SEQ ID NO: 9849 - DNA, 218 bp, Artificial Sequence
  Synthetic polynucleotide
ctcgtacgggccgtacacacgcgtgcagagcatggcgctgccccccggcgtagtgaactcgtacaatggcctgggaggcccgccggccgcacccccgcctcggccgcacccccgcctccgccgcacccccacccgcatccgcacgcacaccatctgcacgcggccgccgcaccgccgcctgccccaccgcaccacggggccgccgcgccgccgccggg

SEQ ID NO: 9850 - DNA, 229 bp, Artificial Sequence
  Synthetic polynucleotide
cccctctgaagacaaggaggacattgaaagcaacctgctccggcccacaggcgtagccctgcgaggagcccacttctgcctgaaggtcttccgggccgaggacttgccgcagagggacttgccgcagagtgcgtggggcgcgcccttgggtgggaggtctgcaggaggctggaggcgcagggctggtgggggtgggcgatggcgggcggggtcagctccctgggggaag

SEQ ID NO: 9851 - DNA, 219 bp, Artificial Sequence
  Synthetic polynucleotide
aaatctgactggactgtgtgtgtctctcctctgtgtcccccagggcccgtcacagctggagctgactctccaggcatccaagcaaaatggcacctggccccaaaatggcacctggccccgagaggtgcttctggtcctcagtgtaaacagcagtgtcttcctgcatctccaggccctgggaatcccactgcacttggcctacgtgagtgtgttccctcc

SEQ ID NO: 9852 - DNA, 219 bp, Artificial Sequence
  Synthetic polynucleotide
gcagtgcctacgtctaagctgggccaggcagaggggcgagatgcaggctcagcaccctccggaggggacccggccttcctgggcatggccgtgagcacccgcatggccgtgagcaccctgtgtggcgaggtgccgctctactacatctaggacgcctccggtgagcaggtgtgatcccagggcccctgatcagcagcggaggagcgctcgggccacctg

SEQ ID NO: 9853 - DNA, 220 bp, Artificial Sequence
  Synthetic polynucleotide
gcgcgactgcgtcacctaccagactgagtaccgctgggaggtgtatcgcaccgccagctgccagcggccggggcgcccagcgcgtgtggccctgcccggcgcgtgtggccctgcccggcgtggacgtgagccggcctcggctggtgctgccgcggctggcgctgcctgtggggcactactgctttgtgtttgtcgtgtcatttggggacacgccactgac

SEQ ID NO: 9854 - DNA, 221 bp, Artificial Sequence
  Synthetic polynucleotide
cggggtggggcttcgtactaacctcgtcccctaagccccgcccctgccccaggttctcctggagctgctgccgcgcctcctgggctccccgccgccgcccggggctccccgccgccgcccgaggccccccgggccgcctcgcccccaaggcgggcgtcgtcggtgggcttattgctccgcgcggaggagctgatactgaaaaagccacggagcgagctcgt

SEQ ID NO: 9855 - DNA, 220 bp, Artificial Sequence
  Synthetic polynucleotide
ctcgactgtgcagggggtggaggtgggcccagcgccgcagggcgaggccttcagcctggagagctgccagaactggctgcccggggagccacacccagccaggggagccacacccagccacagccgagcactgcgtccggctcgggcccaccgggtggtgtaacaccgacctgtgctcagcgccgcacagctacgtctgcgagctgcagcccggaggtgt

SEQ ID NO: 9856 - DNA, 215 bp, Artificial Sequence
  Synthetic polynucleotide
agggggggccctggggcgccccctcccgggcactccctgagggctgcacggcaccgccacaggcactgcacccgttcgcggcggacgacacctgccggacgacacctgccggaccagccagggctccccggctttccagccgcccgagattgccaacggcctggacaccttctccggcttcaaggtggacatctggtcggctggggtcaccctgt

SEQ ID NO: 9857 - DNA, 221 bp, Artificial Sequence
  Synthetic polynucleotide
aggctggaggctgatgcaaatcaggtgctggagtgggtacgggcaccacctcacgtccgatttccagctcgccaggcctggtaccggccagccagccccggtaccggccagccagccccgaaagcctgcattaccacttgtgcagtgccccccgggccctgctgcaggatgtgctgcctaagtatatcctggacttctccctctttgcctacccactgcct

SEQ ID NO: 9858 - DNA, 216 bp, Artificial Sequence
  Synthetic polynucleotide
cggctgcgggcctgggccctcggccccactgaccctcttctctgcacagctcctaagccactgcctgctggtgaccctggccgcccacctccccgccgagcacctccccgccgagttcacccctgcggtgcacgcctccctggacaagttcctggcttctgtgagcaccgtgctgacctccaaataccgttaagctggagcctcggtggccatgct

SEQ ID NO: 9859 - DNA, 218 bp, Artificial Sequence
  Synthetic polynucleotide
ttaaacatggatttttgaaaagtggattgaagacaaatctggttctttcctattagaaaatcaaagaaattacttatatgcactctgaaggcatccttgctctgaaggcatccttgctggtgaattgaaacatggccctctggctttggtggataaattgatgcctgtgatcatgatcatcatgagagatcacacttatgccaagtgtcagaatgctc

SEQ ID NO: 9860 - DNA, 218 bp, Artificial Sequence
  Synthetic polynucleotide
gtgaaatcacaaaggagcgagaagatgagtgttttagttgtggggatgctggccagctcgtctcctgcaagaaaccaggctgcccaaaagtttaccacgcccaaaagtttaccacgcagactgtctcaatctgaccaagcgaccagcaggttggtgccaaaatccatttgtaccgctactcgttctctccatcatactcagggtctcatgccatttgc

SEQ ID NO: 9861 - DNA, 215 bp, Artificial Sequence; identical to SEQ ID NO: 9856
  Synthetic polynucleotide

SEQ ID NO: 9862 - DNA, 218 bp, Artificial Sequence
  Synthetic polynucleotide
cagcagcagcagcagcaacagcagcagcagcagcaggaggcggcggcggcggctgcggcggcggcggcggctgcggcggcggcagctgcagtgccccggtagctgcagtgccccggttgcggccgccccacgacaaccgcaccatggtggagatcatcgccgaccacccggccgaactcgtccgcaccgacagccccaacttcctgtgctcggtgctg

SEQ ID NO: 9863 - DNA, 209 bp, Artificial Sequence
  Synthetic polynucleotide
tgcacctgcagctgctggcccaagctgactacagactcagcgatgtgatgcgagaatcactgctggaagaccagctcagccctgtcctcactgaaccccacaaccccacctccttgccctggatcgaaggctccaaaccatcctaaggacagtggaggggtgcatagtggcccatggacagcagagtgtcatagtcgacggcccagtgg

SEQ ID NO: 9864 - DNA, 217 bp, Artificial Sequence
  Synthetic polynucleotide
ccacagtgtatcggctagcctatctccggctaaatacactttgtgaacgccttctgtctgagcacccagaattagaacatatcatctggacccttttccatctggacccttttccagcacaccctgcagaatgagtatgaactcatgagagacaggcatttggaccaagtaagaaaatcaagcacttcaccttctctcctccctacttacttgttaa

SEQ ID NO: 9865 - DNA, 209 bp, Artificial Sequence
  Synthetic polynucleotide
gatgactttttcgtgttgaagttaactgaataacagctttctcagccaaggcaaagacacattgatttggttcttcctttgtagagagtgttcatctgggaatctgggacttggatgagacaatcattgttttccactccttgcttactgggtcctacgccaacagatatgggagggtgagtaccaagaggcatcagtttttaatttct

SEQ ID NO: 9866 - DNA, 220 bp, Artificial Sequence
  Synthetic polynucleotide
ggtcgtgcagacccgggagaaagatgtcaaacgtgcgagtgtctaacgggagccctagcctggagcggatggacgccaggcaggcggagcaccccaagccaggcggagcaccccaagccctcggcctgcaggaacctcttcggcccggtggaccacgaagagttaacccgggacttggagaagcactgcagagacatggaagaggcgagccagcgcaagt

SEQ ID NO: 9867 - DNA, 220 bp, Artificial Sequence
  Synthetic polynucleotide
cagtgagagctgtgaatgaattctccgggtggacgagggaagaagaaaggctccggcggcgccagcaacccggtgcctcccaggcctccgcccccttgccaggcctccgcccccttgcctggcccccgcccctcccgccgccgggccggcccctccgcccgagtcgccgcataagcggaacctgtactatttctcctacccgctgtttgtaggcttcgcg

SEQ ID NO: 9868 - DNA, 229 bp, Artificial Sequence
  Synthetic polynucleotide
tcaagatgtaaatgaattatatgaagattttgttactttaaaattatttacatattctactcactagggatctccaggataccaaggaccccctggtgaacctgggcaagctggacctgggcaagctggtccttcagtaagtaacaattaaatttatatttagtaagtcgataattccatatggaacctacctttgttttctaaaacaagtataggtctttacagaatg

SEQ ID NO: 9869 - DNA, 214 bp, Artificial Sequence
  Synthetic polynucleotide
cttgtcattgtttaatgcatacttaaacaattttatttttgtcttgaaattattaataatgtggttttctgtccacttcccctatgcaggtgtccaacggaggtgtccaacggatgtgtgagtaaaattctgggcaggtattacgagactggctccatcagacccagggcaatcggtggtagtaaaccgagagtagcgactccagaagttgtaa

SEQ ID NO: 9870 - DNA, 221 bp, Artificial Sequence
  Synthetic polynucleotide
gtttcagcactctacccagaccctcccggccccagggtccacacgtgctcggccgcaggaggcttcagcaccagcgattacgacgttggctgggagagtccgacgttggctgggagagtcctcacaatggctcggggacgtgggcctattcagcgccggatctgctggggtgagcagagcgagggccccgggcgtctacgccaaggacaagggagtagttc

SEQ ID NO: 9871 - DNA, 208 bp, Artificial Sequence
  Synthetic polynucleotide
tcactacttccccatctcccacatccggctatgggccctgcagctgatcttcgtgtccacgccagcgctcctagtggccatgcacgtggcctaccggagaccggagacatgagaagaagaggaagttcatcaagggggagataaagagtgaatttaaggacatcgaggagatcaaaacccagaaggtccgcatcgaaggctccctgtg

SEQ ID NO: 9872 - DNA, 212 bp, Artificial Sequence
  Synthetic polynucleotide
agtaataatgatttgaacaccactgagaagcgtgcagctgagaggcatccagaaaagtatcagggtagttctgtttcaaacttgcatgtggagccatgtgggagccatgtggcacaaatactcatgccagctcattacagcatgagaacagcagtttattactcactaaagacagaatgaatgtagaaaaggctgaattctgtaataaaagc

SEQ ID NO: 9873 - DNA, 220 bp, Artificial Sequence
  Synthetic polynucleotide
gctgatacagagggaggtcccctaactgttgaccttgtgaacagtaaggtcgttgtttcgttctgcagagagacggtgtccatcagcatccgggcctcccttcagcatccgggcctccctgcagcagacccaggctgtccctcttttgatggctcatcagtacctccgcggaagtgtagaaacccaggtgaccatcgcgacggccatcctcgcgggcgtc

SEQ ID NO: 9874 - DNA, 216 bp, Artificial Sequence
  Synthetic polynucleotide
tgcttgctgacgtggctctccatctcttcccagaaaaaattgcctgtgtcgtcccttcagaatgtgagaaatattgcggtaccaaggttggctgtaccaaggttggctgtaccaacatcgcctatccaaccttagtggtggagctcatgcccaatggtgagattctttcttgggaggttggtagagtctttcttgggaggctgattgggtttaggc

SEQ ID NO: 9875 - DNA, 216 bp, Artificial Sequence; identical to SEQ ID NO: 9858
  Synthetic polynucleotide

SEQ ID NO: 9876 - DNA, 220 bp, Artificial Sequence
  Synthetic polynucleotide
aaatagcccagtataagcgggagtgcccgtccatctttgcttgggaaatccgagacagattactgtccgagggggtctgtaccaacgataacataccaagccaacgataacataccaagcgtaagttcattgagaacatctgccctccctgccctaagcccaatgctctctcctctttacctcctcccaccctctctctccactgtctcttagtctgtgt

SEQ ID NO: 9877 - DNA, 217 bp, Artificial Sequence
  Synthetic polynucleotide
aaatgctacagctttgaggctaaatcatatgtcaaataaaactacttcatcaaaaaacatggaaatggtccaacagaaaaaagagggccccattccaccagggccccattccaccagatgcacaaaatccagatatgtcgttctttaagatgctattcttgccagaatcagcaaggtggatacaaaggactcatggaaagaactctctgaactctgg

SEQ ID NO: 9878 - DNA, 218 bp, Artificial Sequence
  Synthetic polynucleotide
atgagccctaccacctgcaccctgaggaaacacaagaccaatcggaagccgcgcacgccctttaccacatcccagctcctcgccctggagcgcaagttcccctggagcgcaagttccgtcagaaacagtacctctccattgcagagcgtgcagagttctccagctctctgaacctcacagagacccaggtcaaaatctggttccagaaccgaagggcc

SEQ ID NO: 9879 - DNA, 215 bp, Artificial Sequence
  Synthetic polynucleotide
gtgcctcctttaaactgttttcatctcacaaggatgttagtagaaagtaaacagaagagtcatatctgttttcacagcccaattatacagaaatccgacagcagaaatccgacagtactgcaatcactggcgaaattttgctgacattgatgattcctggaaaagtataaagagtatcttggactggacatcttttaaccaggagagaattgttg

SEQ ID NO: 9880 - DNA, 217 bp, Artificial Sequence
  Synthetic polynucleotide
cagcgctgtaggggtctttacgtgttccaaggggacagtagcccctgctcggccttcgagttccactgcctaagtggcgagtgcatccactccagctggcatccactccagctggcgctgtgatggtggccccgactgcaaggacaaatctgacgaggaaaactgcggtatgggcggggccagggtgggggcggggcgtcctatcacctgtccctgg

SEQ ID NO: 9881 - DNA, 219 bp, Artificial Sequence
  Synthetic polynucleotide
tcctttcttccctctctccaccagagcgatcgcctcaccggcccatcctccaagccggactgccggcaaatgcctccacagtggtcggaggagacgtagaggtcggaggagacgtagagtttgtctgcaaggtttacagtgatgcccagccccacatccagtggatcaagcacgtggaaaagaacggcagtaaatacgggcccgacgggctgccctacc

SEQ ID NO: 9882 - DNA, 217 bp, Artificial Sequence; identical to SEQ ID NO: 9864
  Synthetic polynucleotide

SEQ ID NO: 9883 - DNA, 218 bp, Artificial Sequence
  Synthetic polynucleotide
ggaagtgcgagccaaggaccaggacatcttggatctggtgggtgtgctgcacgatcccgagactctgcttcgctgcatcgctgaaagggccttcctgaggaaagggccttcctgaggcacctggtagggcctgtgctccacctgtggagggctggggacttggagagctgggaaaggtggcagggaagatttcttacatgaatgctctgtatacagtg

SEQ ID NO: 9884 - DNA, 217 bp, Artificial Sequence
  Synthetic polynucleotide
taagcatgtaatagagtgtgctaaacagaaagccctggaacttgaggagtttcagtatattggagaatcgcaaggatatgatatcatggaaccagcagcacatggaaccagcagcaaagaagtgctatctggaaagagaggtttgtcagtttgttttcatagtttaacttagcttctctattattacataaacaggacactaagatgaaggtttttt

SEQ ID NO: 9885 - DNA, 218 bp, Artificial Sequence
  Synthetic polynucleotide
ggtgaggagcatgggggagatgaggagccacgggccttgtgttgttacagagtttgctgtcatcgtggaggtccacgcagccgcacgttccaccctccaccacgttccaccctccaccctgtggggtgtgaggatgaccagtctctcagcaagtacgagtttgtggtgaccagtgggagccctgtagctgcagaccgaggtgggtgcccccaggcaga

SEQ ID NO: 9886 - DNA, 217 bp, Artificial Sequence
  Synthetic polynucleotide
gtgcctgccaggggggaggctcctaaggcccaccccggtgttttccccgccagctgccttctgccagagcctgggcgccgccgcccccgaggtccgctgctcccgaggtccgctgctgtgtggatgccgtgaacttcgtggccgagagcacgagagatcaggaggccaccggcgaggtgggacaggagccagaggcgggtggagcgaggcagaggcc

SEQ ID NO: 9887 - DNA, 219 bp, Artificial Sequence; identical to SEQ ID NO: 9851
  Synthetic polynucleotide

SEQ ID NO: 9888 - DNA, 214 bp, Artificial Sequence
  Synthetic polynucleotide
ccgaaagcccgctacctgctctgccagctgctgctgccaccttcctcatggagcaacatgagccccggaccccagctctggcacttgcttcaggcccttgcttcaggcccttgtgtctatgtgtataagaatctcagaccctacttcaagttcagcctgccccaattgcctccaaatcctctggaacaagacctttggaaccaggccaaagagg

SEQ ID NO: 9889 - DNA, 215 bp, Artificial Sequence
  Synthetic polynucleotide
agattctgaagctgaagttcccaagaacagaagaagaaagacggatgcggacccaaagtaaaaggaggctagaagctaagaaagagcagcggcagaaaaacagcggcagaaaaactttgtggacctggcctgcgagtgcagcgcagtcatctgctgccgcgtcacccccaagcagaaggccatggtggtggacctggtgaagaggtacaagaaag

SEQ ID NO: 9890 - DNA, 225 bp, Artificial Sequence
  Synthetic polynucleotide
ctccacattctctgccttttcatctctctctgctcggcccagaacacgatcgtgaatgagctggtacgtgtgaccagtgagggagctggcctgcagctgcagaaggtgactgcagaaggtgactgtcctgggcgtggccacggcgccccagcaggtcctctccaacggtgtccctgtctccaacttcacctacagccccgacaccaaggcaagagggcccagagt

SEQ ID NO: 9891 - DNA, 225 bp, Artificial Sequence
  Synthetic polynucleotide
ccctgtttctgtgtttttggcaggatgcaacctgaagatcttcaacaaccaggagttcgctgccctcctggcccagtcggtcaaccagggctttgaggctgtctaccagttgtgtctaccagttgacccgaatgtgcaccatccgcatgagcttcgtcaaaggctggggagcggagtacaggtcagttatgggtgctgcctacatcaggggacccaactccaggt

SEQ ID NO: 9892 - DNA, 219 bp, Artificial Sequence
  Synthetic polynucleotide
tagcccctgctcggccttcgagttccactgcctaagtggcgagtgcatccactccagctggcgctgtgatggtggccccgactgcaaggacaaatctgactgcaaggacaaatctgacgaggaaaactgcggtatgggcggggccagggtgggggcggggcgtcctatcacctgtccctgggctcccccaggtgtgggacatgcagtgatttaggtgcc

SEQ ID NO: 9893 - DNA, 217 bp, Artificial Sequence
  Synthetic polynucleotide
tgtattataacaatttataatcttcacaggccaatcacacaagctggaagacccattacaggtttcctcaggcccagcacgcagagtggaaggccaggcaggtggaaggccaggcactatggaacaggctatcagaacacccagaaccgcctacacagcccgccctatcaccagctcctccggaagatttgtcaggctgggaacggtaaattctatc

SEQ ID NO: 9894 - DNA, 211 bp, Artificial Sequence
  Synthetic polynucleotide
gtttggcatcttcctctacatgggggtcacgtcgctcagcggcatccagctctttgaccgcatcttgcttctgttcaagccacccaagtatcacccagatgcacccagatgtgccctacgtcaagcgggtacaggacccttttctggctgcccagcctggggtggtagagggtgctggggtgtgataggcactgaccccagcctccgcctg

SEQ ID NO: 9895 - DNA, 221 bp, Artificial Sequence; identical to SEQ ID NO: 9870
  Synthetic polynucleotide

SEQ ID NO: 9896 - DNA, 213 bp, Artificial Sequence
  Synthetic polynucleotide
cagggtgcgcgcagctccatctccatcctggagcaggagaaggtcgtcgcgcagcagatccggcagctcttccccaagttcgcggacacccccatttacacccccatttacaacgacgaggcggacccgctggtgggctggtccctgccacagccgtggagggcggacgtgacctacgcggccatggtggtgaaggtgggccggcccaacgcc

SEQ ID NO: 9897 - DNA, 208 bp, Artificial Sequence
  Synthetic polynucleotide
gtactatgaggaggcaagaagcgcctacctgagcaaggagctggcctccctgttgagggctggaggcgtcctggcctatgagctgctgccggcactggacactggacgaggtgctggctagtgacagccgcttcttgctgggcagctggctagagcaggcccgagcagcggcagtcagtgaggccgaggccgatttctacgagcagaa

SEQ ID NO: 9898 - DNA, 225 bp, Artificial Sequence
  Synthetic polynucleotide
gattagagcccacctggaaacccttcatcctcacgcagttctctcgccacacagcaacactgctttccccactcaaccagagccggtgcctgacttacctcacggtgggccttcacggtgggcctcgctggagattttattggtatagcgcagaacctccagctccatatccgtcttaaacactcggcttcagagacagaagaacaaagcagcaaatcagtgact

SEQ ID NO: 9899 - DNA, 216 bp, Artificial Sequence
  Synthetic polynucleotide
gtgtgtcagctcatcttccagatcacaccgctgaacgtgacccagtggctgatggtgctgaaaatctccttgcccgtgattctcatggatgagacgctcatggatgagacgctcaagtttgtggcccgcaactacctggaacctggtaaagagtgtgtgcagcctgccaccaaatcctgctcgttctcggcatgcaccgatgggatttcctggccg

SEQ ID NO: 9900 - DNA, 220 bp, Artificial Sequence; identical to SEQ ID NO: 9867
  Synthetic polynucleotide

SEQ ID NO: 9901 - DNA, 218 bp, Artificial Sequence
  Synthetic polynucleotide
aggggcatccccatcgagcgagtcgtctcctcggagggtggccggccctctgtggacctctccttccagccctcgcagcccctgagcaagtccagctcctgagcaagtccagctcctctcccgagctgcagactctgcaggacatcctcggggaccctggggacaaggccgacgtgggccggctgagccctgaggttaaggcccggtcacagtcaggg

SEQ ID NO: 9902 - DNA, 215 bp, Artificial Sequence
  Synthetic polynucleotide
tcttttctattctttcgttttataggcgaatgtttcctccatttaaagtgagatgttctgggctggataaaaaagccaaatacattttattgatggacatttattgatggacattatagctgctgatgactgtcgttataaatttcacaattctcggtggatggtggctggtaaggccgaccccgaaatgccaaagaggatgtacattcacccgg

SEQ ID NO: 9903 - DNA, 217 bp, Artificial Sequence
  Synthetic polynucleotide
ttcctggagactcacttcctagatgaggaagtgaagcttatcaagaagatgggtgaccacctgaccaacctccacaggctgggtggcccggaggctgggcggcccggaggctgggctgggcgagtatctcttcgaaaggctcactctcaagcacgactaagagccttctgagcccagcgacttctgaagggccccttgcaaagtaatagggcttctg

SEQ ID NO: 9904 - DNA, 215 bp, Artificial Sequence
  Synthetic polynucleotide
tgcccggtgctcacctgtggtcccgccagcttccagtgcaacagctccacctgcatcccccagctgtgggcctgcgacaacgaccccgactgcgaagatggctcggaggctcggatgagtggccgcagcgctgtaggggtctttacgtgttccaaggggacagtagcccctgctcggccttcgagttccactgcctaagtggcgagtgcatccac

SEQ ID NO: 9905 - DNA, 220 bp, Artificial Sequence
  Synthetic polynucleotide
actaactacgtctgttgtctggtcagctctttgacaaaattgccatcctgagcttcggagagctgattttctgtggcacgccagcggaaatgcttgatttcagcggaaatgcttgatttcttcaatgactgcggttacccttgtcctgaacattcaaacccttttgacttctatagtaagtttttctttcacattccccatcatgaatgttttttaaact

SEQ ID NO: 9906 - DNA, 211 bp, Artificial Sequence
  Synthetic polynucleotide
catggaagggtgaggccttgaggttgaggtgggggtgttggctgggggagctgccatgtatgcagttaccagaacgtggcgctggctttgcttccagggacttccagggagtgtgtggggaagacggtgacattgcagggcaacctggacccctgtgccttgtatgcatctgaggtaacagccagggcccctctgtgtgtctgttactgtg

SEQ ID NO: 9907 - DNA, 218 bp, Artificial Sequence; identical to SEQ ID NO: 9849
  Synthetic polynucleotide

SEQ ID NO: 9908 - DNA, 216 bp, Artificial Sequence
  Synthetic polynucleotide
caggcggcacagggcgggcagctcttcgattacatccaggcagtctctagctacctggcaccgcccgtgtccgccgtcttcgtgctggcgctcttcgtgctggcgctcttcgtgccgcgcgttaatgagcaggtgagcggcacgcgcgtggtgacggcagggctgggcttgcacatcctcagcaggctgacctgtttccttcgcagggcgccttct

SEQ ID NO: 9909 - DNA, 227 bp, Artificial Sequence
  Synthetic polynucleotide
gcacgcaccctcctcgtaaggcgtgtactccactttgtacatgccatcgccacggtcctgaacgtaggtctccgtcaggttgcctgaggggttggccacacgggccttgacgtacgggccttgacgtgcggccctccggtctgtgtcagagcccgggcgtccacactgaactcagtggtggcctcacggaagacacctgcaaaggcacagagaggaggcttggggct

SEQ ID NO: 9910 - DNA, 216 bp, Artificial Sequence
  Synthetic polynucleotide
ggggcccgggggcccgggaggcgaacccggcaagggcggcgcagcagcagcggcggcggccgcggcagcggcggcggcggcagcggcagcggcggcagctgcagcggcggcagctggaggcctggctgcggctgggggccctggacaaggctgggctcccggccccggccccatcacctccatcccggattcgcttgggggtcccttcgccagcgt

SEQ ID NO: 9911 - DNA, 220 bp, Artificial Sequence
  Synthetic polynucleotide
cctggccccggcctggggctctgtgtgtttcagcactctacccagaccctcccggccccagggtccacacgtgctcggccgcaggaggcttcagcaccagcaggaggcttcagcaccagcgattacgacgttggctgggagagtcctcacaatggctcggggacgtgggcctattcagcgccggatctgctggggtgagcagagcgagggccccgggcgt

SEQ ID NO: 9912 - DNA, 220 bp, Artificial Sequence; identical to SEQ ID NO: 9866
  Synthetic polynucleotide

SEQ ID NO: 9913 - DNA, 209 bp, Artificial Sequence; identical to SEQ ID NO: 9865
  Synthetic polynucleotide

SEQ ID NO: 9914 - DNA, 216 bp, Artificial Sequence; identical to SEQ ID NO: 9858
  Synthetic polynucleotide

SEQ ID NO: 9915 - DNA, 220 bp, Artificial Sequence
  Synthetic polynucleotide
ccaccttgcctgccccctggatcccaggtttgggagaggggcaggagtgacaggcctcacccccacaggcctggctgtgatgcactcacagggcagcgatgcactcacagggcagcgattacctggacatcggcaacaacccgagagtgggcaccaagcggtacatggcacccgaggtgctggacgagcagatccgcacggactgctttgagtcctacaa

SEQ ID NO: 9916 - DNA, 217 bp, Artificial Sequence
  Synthetic polynucleotide
cctggccaacctgctcctagccttcctgcggcgccagccacagccctggtgcctggtggcacacaatggtgaccgctacgacttccccctgctccaagcaccccctgctccaagcagagctggctatgctgggcctcaccagtgctctggatggtgccttctgtgtggatagcatcactgcgctgaaggccctggagcgagcaagcagcccctcaga

SEQ ID NO: 9917 - DNA, 211 bp, Artificial Sequence
  Synthetic polynucleotide
gtgcctgcttcgcttggcggccttcgcgcacgacgccagcccggccgcccgcgcccagctcttctccgcgctgcacggctatctgcgccccaaaccgccccaaaccgccccggcccaagccggtagatccgaggcctccagcgccgcgcccatccctggaccccgccgcaccggcccttggccctgcgctgcaccagcgccccccagtgca

SEQ ID NO: 9918 - DNA, 215 bp, Artificial Sequence
  Synthetic polynucleotide
aatataactagtaaaagaagttttgtttatttttaaacagaattagttttaacaacattggacttccaaaaggctctccgcggatttcttcctgcgtctttcttcctgcgtctttgcgaagtgtcaacctgcataaacctagagacctgggttgggacaagattggtgggttacatgaagttaggcagatactcatggatactatccagttacct

SEQ ID NO: 9919 - DNA, 217 bp, Artificial Sequence
  Synthetic polynucleotide
taggttacctacatctcatacttgctttaatgtgcttttacttccggaatactcaagcaaagaaaaacttaaagagagattgttgaaggccatcacgtatgaaggccatcacgtatgccaaaggatttggcatgctgtaaaacaaaacaaaacaaaataaaacaaaaaaaaggaaggaaaaaaaaagaaaaaatttaaaaaattttaaaaatataac

SEQ ID NO: 9920 - DNA, 220 bp, Artificial Sequence
  Synthetic polynucleotide
acagctccagacactcaggcattgggcacggacaagcttcatctgcagtcagagacagtggacaccgagggtacagtggtagtcaggccagtgacaatgagtcaggccagtgacaatgagggacattcagaagactcagacacacagtcagtgtcagcccacggacaggctgggtcccatcagcagagccaccaagagtccgcacgtggccggtcagggg

SEQ ID NO: 9921 - DNA, 217 bp, Artificial Sequence
  Synthetic polynucleotide
gcctctaactccagcccccttcagcatctccggctacgacatccctgagggcacagtcatcattccgaacctccaaggcgcccacctggatgagacggtccctggatgagacggtctgggagaggccacatgagttctggcctggtatgtggggggccgggggcctgccgtgaaaatgtggtggaggctggtccccgctgccgctgaacgcctcccc

SEQ ID NO: 9922 - DNA, 219 bp, Artificial Sequence
  Synthetic polynucleotide
gtgggaggggaggcgggaaacagcttagtgggtgtggggtcgcgcattttcttcaaccaggaggtgaggaggtttcgacatggcggtgcagccgaaggaggcggtgcagccgaaggagacgctgcagttggagagcgcggccgaggtcggcttcgtgcgcttctttcagggcatgccggagaagccgaccaccacagtgcgccttttcgaccggggcga

SEQ ID NO: 9923 - DNA, 207 bp, Artificial Sequence
  Synthetic polynucleotide
gcaatgtcttcttttttgaaaggatataattgacactggcaaaacaatgcagactttgctttccttggtcaggcagtataatccaaagatggtcaaggtcaaggtcgcaaggtatgtatgacattttgacacagaatattttcctcatttgaagggggattaagtgattgcttctttttaaggataaatgttttcaactgtcatttt

SEQ ID NO: 9924 - DNA, 220 bp, Artificial Sequence
  Synthetic polynucleotide
agctgaccaacctgaaggtgtgcattgaattaacagggctccatcctaaaaaacaacgccacttgctgcaccttagagaacgatgggagcagcaggtgtcgatgggagcagcaggtgtcggcagcagatggcaaacctggccggcaaagcaggaaggaagtgacccaggccactcagcctgaggccattcctcaggggactaacatcactgaagagaaac

SEQ ID NO: 9925 - DNA, 221 bp, Artificial Sequence
  Synthetic polynucleotide
gccttgtcagtgcttgattacatactctgtctccttccgttaattttagaatgagagcgctcgctgtgctgtctgtcacgctggttatggcctgcacagactggttatggcctgcacagaagccttcttccccttcatctcgagagggaaagaactcctttggggtaagtagcaaacacattgcggtcttctggccttataaagttatttttcacacttac

SEQ ID NO: 9926 - DNA, 217 bp, Artificial Sequence
  Synthetic polynucleotide
accccacccccagctgcggggcgaatggaggcggcggcggcgggcccagcccggctggagctccgggggcggcggggcccgggggcccgggaggcgaaccccccgggaggcgaacccggcaagggcggcgcagcagcagcggcggcggccgcggcagcggcggcggcggcagcggcagcggcggcagctggaggcctggctgcggctgggggccctg

SEQ ID NO: 9927 - DNA, 215 bp, Artificial Sequence
  Synthetic polynucleotide
agctattctctgtcctcccaccagcttcatgtactggactgactggggaactcccgccaagatcaagaaagggggcctgaatggtgtggacatctactcgctggtgagctggtgactgaaaacattcagtggcccaatggcatcaccctaggtatgttcgcaggacagccgtcccagccagggccgggcacaggctggaggacagacgggggttg

SEQ ID NO: 9928 - DNA, 214 bp, Artificial Sequence
  Synthetic polynucleotide
tctcgtaccgcgcgcgctgcgagccgcctgccgtcgggaccgcgtgcacgcgcctctgccgtccgcgcagcgccccctcgcggtgcggtccgggactgcggtccgggactgcgcccctgcgcaccgctcgaggacgaatgtgaggcgccgcgtgagtcctgcgttcgaccccaccccgtcccagccggggaccccggcccctcctgagcgtcac

SEQ ID NO: 9929 - DNA, 215 bp, Artificial Sequence
  Synthetic polynucleotide
aggaggacattgaaagcaacctgctccggcccacaggcgtagccctgcgaggagcccacttctgcctgaaggtcttccgggccgaggacttgccgcagaggacttgccgcagagtgcgtggggcgcgcccttgggtgggaggtctgcaggaggctggaggcgcagggctggtgggggtgggcgatggcgggcggggtcagctccctgggggaagg

SEQ ID NO: 9930 - DNA, 212 bp, Artificial Sequence
  Synthetic polynucleotide
aatgatgtttttcaggccttcaactcaaaccatatcataaacccttgcaacatgttcgtgactggccagaaatacttgctgaattgactaatctggatcctatctggatcctcaaagggaaacacctcagctttttctaagaagagatgtgagacttcccttggaagttgaaaaacaggtttgcttggaaatcttatttacagttatttaaa

SEQ ID NO: 9931 - DNA, 229 bp, Artificial Sequence; identical to SEQ ID NO: 9868
  Synthetic polynucleotide

SEQ ID NO: 9932 - DNA, 217 bp, Artificial Sequence
  Synthetic polynucleotide
gaggcagagcatacgcagcctgtacccagtggtgccgagcctctggcggtgccaagcctcacaccacccccacccacagatccactgtgcgacgagctgtgccgcacgtgccgcacggtgatcgcagccgctgtcctcttctccttcatcgtctcggtgctgctgtctgccttctgcatccactgctaccacaagtttgcccacaagccacccatct

SEQ ID NO: 9933 - DNA, 215 bp, Artificial Sequence
  Synthetic polynucleotide
cttactacggagcacatttgcagtgaattgaggaatttgaatattttgaagaatgtttccgctgaatattcaatctacatcgcttgcgagccttccccttcgagccttccccttcagcgaacaatgaaatacatgtggccattgtaagtataagacccattcacacctcattattcgatggcaaggcagttcggttaaccagtgtctgaatggag

SEQ ID NO: 9934 - DNA, 214 bp, Artificial Sequence
  Synthetic polynucleotide
gggctcttctggccccagggtctctcaccctgtctctctcctgtccctcccctccagctggatgctgatgatgccaaggcaacctttgatgaggaggaaggatgaggaggaaggtcgggatgaatacgacgaagtggccatgcctgtgtgaggggcgggcccaggccctagaccctcccccaccattccacatccccaccttccaaggaaaagc

SEQ ID NO: 9935 - DNA, 227 bp, Artificial Sequence
  Synthetic polynucleotide
gtaggtttctgctgtgcctgactggcatttggttgtacttttttttctttatctcttcactgctagaacaactatcaatttgcaattcagtacaattaggtgggcttagatttgtgggcttagatttctactgactactagttcaagcgcatgaatatgcctggtagaagacttcctcctcagcctattctttttaggtgcttttgaattgtggatatttaattcga

SEQ ID NO: 9936 - DNA, 215 bp, Artificial Sequence; identical to SEQ ID NO: 9933
  Synthetic polynucleotide

SEQ ID NO: 9937 - DNA, 219 bp, Artificial Sequence
  Synthetic polynucleotide
ccgccgcgggaggagcccggactcgggccgaggctgcccaggcaatgcgttcactcggcgcaaacatggctgcggccctgcgcgccgcgggcgtcctgctcgccgcgggcgtcctgctccgcgatccgcgtaagtgggtctgtcgcggcggccgccagggccaggatccctgagaaggcgtgggcagagcgggcagctggcgcccgggccctcgcgccc

SEQ ID NO: 9938 - DNA, 213 bp, Artificial Sequence; identical to SEQ ID NO: 9896
  Synthetic polynucleotide

SEQ ID NO: 9939 - DNA, 215 bp, Artificial Sequence
  Synthetic polynucleotide
cgcggctcgggcacactggacgtacctgtgggggaaggagctggatgtgcaggccccgcccaccccgccgcaggccacctacggccccgcggtcacgctacctggcgacctggcgcggctcgcggcgtctgggtttgtgttgtcgatggcgacccgtttcccttgcttcagggctgtctcacacgtggtcacacagcgctgccaggagcctagcg

SEQ ID NO: 9940 - DNA, 218 bp, Artificial Sequence; identical to SEQ ID NO: 9859
  Synthetic polynucleotide

SEQ ID NO: 9941 - DNA, 223 bp, Artificial Sequence
  Synthetic polynucleotide
ttgcgttctctccttgtgccctgccgtgagccaggcctttcttaattaccttgggggagtcactggtcactgttacccggaagaggtacatggacactgtcatgccagccatcatgccagccatcatgaacagcaacaggccatggcgagggttcccgtagttggacagtcccgcctatggatacagtcccggcaatgtcacgtcctcagaacagggcagaga

SEQ ID NO: 9942 - DNA, 217 bp, Artificial Sequence
  Synthetic polynucleotide
gctacctggagatcagcctgcggctgcaccgcttgctgcgcgacagcgaggccttctgccaccgcaactgcagcgccgcgccgcagcccgagcccgccgcagcccgagcccgccgccggcctcgccagctatcccgagctgcgcctcttcgggggcctgctgcgccgcgcgcactgcctcaagcgctgcaagcagggcctgccagccttccgccagt

SEQ ID NO: 9943 - DNA, 215 bp, Artificial Sequence
  Synthetic polynucleotide
tatagtctttctctcctctagcaaccttggaattcagagtcctactcacctgcgtagtgataaatattggttgtgaggccacaggggaactagtcacatgattggcagattggcattctgcatgacctgaacaggcctcaatactggttgagtaaccattgtgcccagacctggggctggattctgggtcaggatgagtggctgtccaccttgct

SEQ ID NO: 9944 - DNA, 218 bp, Artificial Sequence
  Synthetic polynucleotide
tggggctctaggcagtttgtctggggtgggacttggcatccctgcgccctgtgactctctgcccctgcgccccagggagcgcgggggcttctttagcccgggggcttctttagcccggaacccggtgagcccgacagcccctggacgggctcaggtggcaccacgccctccacccccacaacccccaccacggagggtgagggcgacggactctccta

SEQ ID NO: 9945 - DNA, 211 bp, Artificial Sequence; identical to SEQ ID NO: 9906
  Synthetic polynucleotide

SEQ ID NO: 9946 - DNA, 208 bp, Artificial Sequence
  Synthetic polynucleotide
gtggcctaccggagacatgagaagaagaggaagttcatcaagggggagataaagagtgaatttaaggacatcgaggagatcaaaacccagaaggtccgcattccgcatcgaaggctccctgtggtggacctacacaagcagcatcttcttccgggtcatcttcgaagccgccttcatgtacgtcttctatgtcatgtacgacggcttc

SEQ ID NO: 9947 - DNA, 209 bp, Artificial Sequence
  Synthetic polynucleotide
atggatgaaggctcagaagcatcctcctgctcatctgctttggcctcgaagcccagcccagagggagcctctgctgccagctttgagtacactatcctggaatcctggaccccagctcccagctcttgcgtccatggacactgtgccctgagctgccccctaccccaccccacctaaagtacctgtaccttgtggtatctgactctggc

SEQ ID NO: 9948 - DNA, 218 bp, Artificial Sequence
  Synthetic polynucleotide
gaccactgccccctccaccccctggagctggtgggccacccatgccaccaccaccgccaccaccgccaccgccgcccagctccgggaatggaccagccccgggaatggaccagcccctcccccactccctcctgctctggtgcctgccgggggcctggcccctggtgggggtcggggagcgcttttggatcaaatccggcagggaattcagctgaaca

SEQ ID NO: 9949 - DNA, 211 bp, Artificial Sequence
  Synthetic polynucleotide
gtgtgagatggtgcagcccagtggtggcccggcagcagatcaggacgtactgggcgaagagtctcctctggggaagccagccatgctgcacctgccttcacctgccttcagaacagggcgctcctgagaccctccagcgctgcctggaggagaatcaagagctccgaggtgaggaaagagtcaggggatccagccctgctgaggggaaggc

SEQ ID NO: 9950 - DNA, 209 bp, Artificial Sequence
  Synthetic polynucleotide
tcagagcgtctggtgagatgctgttgccgctgctgctgctgctacccatgtgctgggccgtggaggtcaagaggccccggggcgtctccctcaccagtgaaccagtgagtcctcctgttcaccctcccgccaggctggaggtgggaggggccaacattgggccttagggataggcatttacagccttttgactcagtttcccggtagtg

SEQ ID NO: 9951 - DNA, 212 bp, Artificial Sequence
  Synthetic polynucleotide
ctgtgtgagatggtgcagcccagtggtggcccggcagcagatcaggacgtactgggcgaagagtctcctctggggaagccagccatgctgcacctgccttgcacctgccttcagaacagggcgctcctgagaccctccagcgctgcctggaggagaatcaagagctccgaggtgaggaaagagtcaggggatccagccctgctgaggggaag

SEQ ID NO: 9952 - DNA, 218 bp, Artificial Sequence; identical to SEQ ID NO: 9885
  Synthetic polynucleotide

SEQ ID NO: 9953 - DNA, 211 bp, Artificial Sequence
  Synthetic polynucleotide
ttatacgtagtaggtgctcagtagatgttgcatgcatccatgattagtcccttggtcacaaactgttgtgctttttcctagtactccacccacctgcacccacctgcaccttgctgaggactgtatgaagcattaccaaggcaccgtagacaaactctgccgagtggagcaggtaggactctccttctgccacggcaagtttttgccaggc

SEQ ID NO: 9954 - DNA, 208 bp, Artificial Sequence
  Synthetic polynucleotide
ttctagtacctaaggaaattcagaaaagagcaatgcatcaaccaataaccattttttcttatttcattacagagaagaggtgaagagtccagtgaaatggaaaatggagcaaatttcaatcattgaaaggttcccttatcccttccaggtgagttattttctctcaccaaatctcgaaaggcccctgtaacacaattagaaggggtgg

SEQ ID NO: 9955 - DNA, 219 bp, Artificial Sequence
  Synthetic polynucleotide
gcgtcatccctaccaacgttcccgagctcaccttccagcccagccccgcccccgacccgcctggcggcctcacctactttcccgtggccgacctgtctatcgtggccgacctgtctatcatcgccgccctctatgcccgcttcaccgcccagatccgaggcgccgtcgacctgtccctctatcctcgagaagggggtgtctccagccgtgagctggtga

SEQ ID NO: 9956 - DNA, 219 bp, Artificial Sequence
  Synthetic polynucleotide
ctgggaacataggttttgattgtcacctcaatgggactgcttcacagaagaaaagcctggttcataaaactttgcctgatgttctagcagaacctttatcactagcagaacctttatcaagtgaaagacatgagtttgtgatggcacaatatgtgaatgaatttcaggtaaattgttggtaacatttattgtgctttcctgattattaatgctatatga

SEQ ID NO: 9957 - DNA, 205 bp, Artificial Sequence
  Synthetic polynucleotide
aaaaagacctcatttataataaggtcactccaacatttcaccactggaagattgatgacaagaagtttggtcttacgtttcaaagtcctgctgatgctagctagggcttttgatagaggtatccgaagagctatagaggatatttctcaaggtaggtattcttgactattttcttaatttatttatcggttatatatagtagagg

SEQ ID NO: 9958 - DNA, 211 bp, Artificial Sequence
  Synthetic polynucleotide
gcctggtccaataccaggtggggctcttcctgtccactcccagcctcccactgtcccaccgcctcctgcctctctcctctctccccagaacatccagagtcatccagagtctgtcccctgtgaagaagaagaagatggtgcctggggctctgggggtccccgctgacctggcccctgttgacgtcgagttctcctttcccaagttctcccg

SEQ ID NO: 9959 - DNA, 209 bp, Artificial Sequence
  Synthetic polynucleotide
ctgaccatccagaagggcagtgggcggcaggaggatgagcgggaagtggcagagtttatggagcagcttggcacagccttgcgacctgacaaggtaccgcggtaccgcgagacatgcgtcgctgctgtttctgtcatgaggagggtgacggggccactgatgggcctgcccgtctgctgaacctggacctggacctgtgggtgcacctc

SEQ ID NO: 9960 - DNA, 212 bp, Artificial Sequence
  Synthetic polynucleotide
tacagttgatatagaagatcatgagtgtgctgtgtggctgctcctacggaagagcaagtcagatgacaaaaccacgcgactcgaggctgtgcgggaaatgtgcgggaaatgtcggagacccatcactggcatggtaatgagactacctgaacaggtggcatgccttcagctggctcttgattgctgacataaaagacaagggagtggccagg

SEQ ID NO: 9961 - DNA, 215 bp, Artificial Sequence
  Synthetic polynucleotide
gagtttgctgaagaggaagatgttacccagggcagccttgctggtcaccacgcggcccagggcactgagggacctccagctcctggcgcagcagccgatctgcagcagccgatctacgtaagggtggagggcttcctggaggaggacaggagggcctatttcctgagacactttggagacgaggaccaagccatgcgtgcctttgagctaatgag

SEQ ID NO: 9962 - DNA, 221 bp, Artificial Sequence
  Synthetic polynucleotide
ccgaccttggcccgcggccgccggtgagcctagacccgcgcgtctccatctacagcacgcgccgcccggtgttggcgcgcacccacgtccagggccgcgtacccacgtccagggccgcgtctacaacttcctcgagcgtcccaccggctggaaatgcttcgtttaccacttcgccgtgtgagtatcgccaccggcgacggccggcacgaaggtgcttcctg

SEQ ID NO: 9963 - DNA, 208 bp, Artificial Sequence
  Synthetic polynucleotide
gctggccctggtggccctgggtgtcctgggcctgtggcatgtccgacggaggcaggagaagcagcgtggcctgcacagcgagctgggagagtccagtctccagtctcatcctgaaagcatctgagcagggcgacagcatgttgggggtatgggcctggggacctgggacacagggtgtaggaggggcagataggaactgcagaatcag

SEQ ID NO: 9964 - DNA, 207 bp, Artificial Sequence
  Synthetic polynucleotide
ccccccgcagaaacgtctacaaggacctgcggcagatcgagctggcctgtgactcccaggaagacgtggacagctggaaggcctcgttcctccgagctggagctggcgtctaccccgagaaggaccaggtgaggagccgtcctgcgcagccaggcccagagcccccacctgggagaggaagcagggctggctttccccaggacaggt

SEQ ID NO: 9965 - DNA, 211 bp, Artificial Sequence
  Synthetic polynucleotide
acacacttctctctgtgcctttagaagtcggggacttcctctccctggacctgggtggcactaacttcagggtgatgctggtgaaggtgggagaaggtgagagaaggtgaggaggggcagtggagcgtgaagaccaaacaccagatgtactccatccccgaggacgccatgaccggcactgctgagatggtgagcagcgcaggggccgggg

SEQ ID NO: 9966 - DNA, 217 bp, Artificial Sequence
  Synthetic polynucleotide
acggccgatcctgagccacctttggaagagctgggctaccacatctactccagcgacccaccttttgaagttcgtggtgccaatcagtggatcaagtttacagtggatcaagtttaagtcagtcagttaaggggaggagaaggagaggttataccttcagggggctaccagacagtgttctcaacttggttaaggaggaagaaaacccagtcaatga

SEQ ID NO: 9967 - DNA, 214 bp, Artificial Sequence
  Synthetic polynucleotide
cagtgccagtcctttccaaagaatgtgcatcaggggagagaggccgccgcatgagtcaaatgaagaccccgcacaatcccttggactccagcgccccactccagcgccccactgatgaagaaagggaagcagagggagatccccaaggccaagaagccaacctcactgaagaaggtatgtggggtgtttcagccgaagtgaggcactagaaaac

SEQ ID NO: 9968 - DNA, 212 bp, Artificial Sequence
  Synthetic polynucleotide
atattaaagtcgtaattttgtttctaaactcatttggcccacaggtggaaatggtgtattcattgttgtcaatgcttggtactcatgataaggatgatataaggatgatatgtcgcgaactttgctagctatgtctagctcccaagacagctgtatatccatgcgacagtctggatgtcttcctctcctcatccagcttttacatggcaatg

SEQ ID NO: 9969 - DNA, 214 bp, Artificial Sequence
  Synthetic polynucleotide
gccctccagtgggtccgctctccctggggctggcgacagtggacatccagaaccctgacatcacgagttcacgataccgtgggctcccagcacctggacccagcacctggacctagcccagctgataagaaacgctcagggaagaagaagatcagcaaagctgatattggtgcacccagtggattcaagtgagagccactccccagtggaccca

SEQ ID NO: 9970 - DNA, 220 bp, Artificial Sequence; identical to SEQ ID NO: 9866
  Synthetic polynucleotide

SEQ ID NO: 9971 - DNA, 216 bp, Artificial Sequence
  Synthetic polynucleotide
gctcacattccgtctctctggggaacacttttagagcctacatggaggacgcgcccctgctgagaggagccgtgttttttgtgggcatggctctctggggcatggctctctggggagcccaccggctctattctctcaggaactcgccgacatctgtgttgccatcattttaccaggtaaggcggtttctgtgtgcagtgagctggcaggaacggg

SEQ ID NO: 9972 - DNA, 217 bp, Artificial Sequence; identical to SEQ ID NO: 9886
  Synthetic polynucleotide

SEQ ID NO: 9973 - DNA, 212 bp, Artificial Sequence
  Synthetic polynucleotide
ggctggagcaacggcagctacagcatgatgcaggaccagctgggctacccgcagcacccgggcctcaatgcgcacggcgcagcgcagatgcagcccatgcgcagcccatgcaccgctacgacgtgagcgccctgcagtacaactccatgaccagctcgcagacctacatgaacggctcgcccacctacagcatgtcctactcgcagcagggc

SEQ ID NO: 9974 - DNA, 210 bp, Artificial Sequence
  Synthetic polynucleotide
cgtcactgtgaaggtcagcatgtgcccagatttttgctttgagaatataaaaaaaacttttattttctgttccagaactttccatgactggatcacagggatcacagggaaaaaccgaccgagctcaggaagcctaatccaggtggtaaccacagaaggaaggacggaactcaccccagcatatttttaggcctcatctcagtgcctatg

SEQ ID NO: 9975 - DNA, 219 bp, Artificial Sequence
  Synthetic polynucleotide
cttttattacagaattcagccttttctacattcattctgtctttagtgagtaataaactgctgttctcatgctgtaatgagctggcatgagtatttgtgccacatggctccacatggctccacatgcaagtttgaaacagaactaccctgatacttttctggatgcctctcagctgcacgcttctcagtggtgttcaaatcattattactgggttgatg

SEQ ID NO: 9976 - DNA, 211 bp, Artificial Sequence; identical to SEQ ID NO: 9953
  Synthetic polynucleotide

SEQ ID NO: 9977 - DNA, 208 bp, Artificial Sequence
  Synthetic polynucleotide
ttggctggtctcacaattgtactttactttgtattatgtaaaaggaatacacaacgctgaagaaccctgatactaagggatatttgttcttacaggcaacaggcaacaatgcaggatttggaacagaggcgtccccagttggaagaactcattaccgctgcccaaaatttgaaaaacaagaccagcaatcaagaggctagaacaatca

SEQ ID NO: 9978 - DNA, 216 bp, Artificial Sequence
  Synthetic polynucleotide
gcagagcgggcttgccttctccctcaggtggccaaagtggagaagttcaaacacactcagagcaccaaggacagcctgcacgccaagtacaacaccgccacgtacaacaccgccacctgtggcacggtggtgggcgacgaccagtggggccacctccaggtggatgccacctctctcttcctcctgttcctggcccagatgaccgcctcaggtgag

SEQ ID NO: 9979 - DNA, 205 bp, Artificial Sequence
  Synthetic polynucleotide
tggggaactcccgccaagatcaagaaagggggcctgaatggtgtggacatctactcgctggtgactgaaaacattcagtggcccaatggcatcaccctagctaggtatgttcgcaggacagccgtcccagccagggccgggcacaggctggaggacagacgggggttgccaggtggctctgggacaagcccaagctgctccctga

SEQ ID NO: 9980 - DNA, 220 bp, Artificial Sequence
  Synthetic polynucleotide
cccgccctctctcccgcagttctcagggctgcgcagggacctgccgccctcggtgcacctgctcacgctggccagctggggccccgaaatggtgctgctgccccgaaatggtgctgctgcgcttggagcaccagtttgccgtaggagaggattccggacgtaacctgagcgcccccgttaccttgaacttgagggtgagaagggcaaaattgagaaggag

SEQ ID NO: 9981 - DNA, 212 bp, Artificial Sequence
  Synthetic polynucleotide
caaaccctacaacagcagcggcctgggcggcccctccatcaaggacaagtatgtgacggcgctctacttcaccttcagcagcctcaccagtgtgggcttcgtgtgggcttcggcaacgtctctcccaacaccaactcagagaagatcttctccatctgcgtcatgctcattggctgtgagtgtgcccaggggcgggcggcggggagagccca

SEQ ID NO: 9982 - DNA, 219 bp, Artificial Sequence
  Synthetic polynucleotide
gcactggggggcgctggtgcagcgcagggccaagggccggtgcggcggggtccagggatgggcgcggcgctggaggcctcggatctaccggcttgggccggggcggtttggggcggtttggggcgcagatagccgtgcagcgcggagaagagctgggcgcgggcggccgggctggcgtcgtgcgcgaaggccgccaagcgaagcaggcactcgcggaaa

SEQ ID NO: 9983 - DNA, 216 bp, Artificial Sequence
  Synthetic polynucleotide
agggggttgcctgtacctcggggagcccaagccccttttgagggcactgacgctcacgccccccgggtcttccaacacctgcagccaacatggcagcagccaacatggcagcagccttcggaggcttcctctacttcttcacctacatcccctacttcttcgtggcccctcggtacaactggatgactctgagccagaagctctgctcctgcctcc

SEQ ID NO: 9984 - DNA, 208 bp, Artificial Sequence
  Synthetic polynucleotide
ccgcccctggccggcaccagcggtcagcccgcagcctcgaggcaagcagccctgcccctggcactatccgcccgcggggacggccactcaccgatgacggcattggcgcattggcgatggtgatcttgagccacatgcggtcgcggatctccagtcccgagtctggcagctgcatgacccggacgacggcgctcatgtcactcttcac

SEQ ID NO: 9985 - DNA, 215 bp, Artificial Sequence
  Synthetic polynucleotide
gcgcaagggcaactactggacgctggacccggcctgcgaagacatgttcgagaagggcaactaccggcgccgccgccgcatgaagaggcccttccggccgcgcccttccggccgccgcccgcgcacttccagcccggcaaggggctcttcggggccggaggcgccgcaggcgggtgcggcgtggcgggcgccggggccgacggctacggctacct

SEQ ID NO: 9986 - DNA, 225 bp, Artificial Sequence; identical to SEQ ID NO: 9898
  Synthetic polynucleotide

SEQ ID NO: 9987 - DNA, 205 bp, Artificial Sequence
  Synthetic polynucleotide
cagctgaccgttaaaagacaaggactctattatatctatgcccaagtcaccttctgttccaatcgggaagcttcgagtcaagctccatttatagccagccagcctctgcctaaagtcccccggtagattcgagagaatcttactcagagctgcaaatacccacagttccgccaaaccttgcgggcaacaatccattcacttggga

SEQ ID NO: 9988 - DNA, 217 bp, Artificial Sequence
  Synthetic polynucleotide
cagagcaaagtacagagtcaagagttccaaagccacagaccccagacccccccaggccaaagagaagctgcacttacggaggcaccagcaggcccaggggacccaggagacccaggagtaccaggttcaccgcgaggaccttgagcaccttcaggaccacgggcaccagtggggccggcttcaccctgggaagagacagggaggatgaaatgaagaa

SEQ ID NO: 9989 - DNA, 209 bp, Artificial Sequence
  Synthetic polynucleotide
gcgatgcgaagaaccctgctgctgtgctgcccctgatgctgccaggaatggcgggcctgcccaacgtgtttggcttgggcgggctgttgaataaccctctaaccctctgtcagctgctactggaaacaccactactgcttctagtcaaggagaaccggaagacagcacttcaaaaggagaggagaaaggaaatgagaatgaagacgaga

SEQ ID NO: 9990 - DNA, 221 bp, Artificial Sequence
  Synthetic polynucleotide
gaagaagagggctctgggcagcctgtggctggagaagttacctcggatcctttagccagagcaaatccgccccctagtagcagcacgatgccccagggcactttctcctgactttctcctgggttaccttccaatccagcaggggagggggataaaatggagttttcctttctgggaagaaaaagaaacacacacacacacacacacacacacacacacac

SEQ ID NO: 9991 - DNA, 208 bp, Artificial Sequence
  Synthetic polynucleotide
ggccagtctccggacctggcgcaccacgccgccagccccgcggcgctgcagggccaggtatccagcctgtcccacctgaactcctcgggctcggactacggactacggcaccatgtcctgctccaccttgctatacggtcggacctggtgagaggacgccgggccggccctagcccagcgctctgcctcaccgcttccctcctgcccg

SEQ ID NO: 9992 - DNA, 220 bp, Artificial Sequence
  Synthetic polynucleotide
tgcctgccaggggggaggctcctaaggcccaccccggtgttttccccgccagctgccttctgccagagcctgggcgccgccgcccccgaggtccgctgctgcccccgaggtccgctgctgtgtggatgccgtgaacttcgtggccgagagcacgagagatcaggaggccaccggcgaggtgggacaggagccagaggcgggtggagcgaggcagaggccc

SEQ ID NO: 9993 - DNA, 217 bp, Artificial Sequence
  Synthetic polynucleotide
ctcgtgctcaggctgctccaggcatgtgggaagctgaagcggcagctctgcgccatctaccggctgaactttctgaccacagcccccagcaggggaggcccccagcaggggaggcccacacctgccccagcacctgcaggaccaagtgcagaggctcatgcggtaagtgcagtgcggccccctgggtggccagggcagggtctggggcccgtacttc

SEQ ID NO: 9994 - DNA, 214 bp, Artificial Sequence
  Synthetic polynucleotide
ctggcaccggaggtggcggcggcggcggcggggcgagcggcgggactagcggcagctgcagccccgcgtcctcggagccgccggctgcgcccgccgaccgcgcccgccgaccgcctgcgcgccgagagcccgtcgccgccgcgcctgctggccgcgcactgcgcgctgctgcccaagccgggcttcctgggcgcgggcggcggcggcggcggca

SEQ ID NO: 9995 - DNA, 205 bp, Artificial Sequence
  Synthetic polynucleotide
ccatgcagcctggaatttgaggctacccagtgccccaacccattctcctacgtgcccaggcctctctcctctcattcagatcacatgaccttcctgcagccagcgggtgaagaacatgctcattgccttttcacagaactttctgtgcgacgtggtttattccccgtatgcaacccttgcctcagaattccttcagagagaggtg

SEQ ID NO: 9996 - DNA, 207 bp, Artificial Sequence
  Synthetic polynucleotide
ccagtggctattcatccctggcaaccctggagggcagcatggatggagaggagcaggccccccagctctacgtcctgtatgagaaaggccggaaccactaccactacacagagagcatctccgtggccaaaatcagtgtctatgggacactctgagctgtgccactgccacaggggtattctgccttcaggactctgccttcaggaa

SEQ ID NO: 9997 - DNA, 221 bp, Artificial Sequence
  Synthetic polynucleotide
cagccgccgccagccgcagccatgggccgggcccggccgggccaacgcgggccgcccagccccggccccgccgcgcagcctcccgcgccaccgcgccgcctcccgcgccaccgcgccgccgcgcccgttccctggcgctgctcggagccctgctggccgccgccgctgccgccgccgtccgggtctgcgcccgccacgccgaggcccaggcggccgcgcgg

SEQ ID NO: 9998 - DNA, 213 bp, Artificial Sequence
  Synthetic polynucleotide
ccaccctgagcaatggcggctgccagtatctgtgcctccctgccccgcagatcaacccccactcgcccaagtttacctgcgcctgcccggacggcatgctgctggctgctggccagggacatgaggagctgcctcacaggtgtggcacacgccttgtttctgcgtcctgtgtcctccaactgccccctcctgagcctctctctgctcatctgt

SEQ ID NO: 9999 - DNA, 217 bp, Artificial Sequence
  Synthetic polynucleotide
catcccccgggctcaggaggctgctctgctcccccaggtcttcacctcagacactgaggcctccagtgagtccgggcttcacacgccggcatctcaggccgccggcatctcaggccaccaccctccacgtccccagccaggaccctgccagcatccagcacctgcagccggcccaccggctcagcgccagccccacaggtgagaggccctggctcca

SEQ ID NO: 10000 - DNA, 227 bp, Artificial Sequence
  Synthetic polynucleotide
ttccctccccatagttaccgtacacgagaagaaattcaggaagtaagaagtaagagtgaccctattatgcttctcaaggacaggatggtgaacagcaatcttgccagtgtggacttgccagtgtggaagaactaaaggtacagtcacttgttcatggtggtttgaaggttggctttaaaagttgccacccctgggtggccacagagtttgtgtgggttcctccaagc

SEQ ID NO: 10001 - DNA, 215 bp, Artificial Sequence
  Synthetic polynucleotide
tttgttatatataaatattagtttatatgttcataattattttcaacgtatattacagagtattaaagaatctgaagaggaactatattgtgcctattctattgtgcctattctttggcttaatgaggtttgtatttgcagctgttagtcattaaaaacaaccttctttgtatataaacaagctcttgatgtttcaaaagaatgtatagtattta

SEQ ID NO: 10002 - DNA, 208 bp, Artificial Sequence
  Synthetic polynucleotide
gagctggctctgctgcagcagcctgaggaccagcctgactctgccctcccagaaatcctgcagtttaacctgctgggggtgcctctggtcggggccgacggccgacgtctgcggcttcctgggcaacacctcagaggagctgtgtgtgcgctggacccagctgggggccttctaccccttcatgcggaaccacaacagcctgctcagt

SEQ ID NO: 10003 - DNA, 219 bp, Artificial Sequence
  Synthetic polynucleotide
tgggatacatactactgaatgcaaaggacaccacacacacgcatgtgcacacacacacacgctttttacctgagtggttaaaatgtcactctgagaggatagccctgagtagccctgagcagtcttcagagacgcttgtttcactctcacacccagatgctgcttcaccttaaataacaaaaacagaggttcagatgtaaaagcagactataaacgctg

SEQ ID NO: 10004 - DNA, 214 bp, Artificial Sequence
  Synthetic polynucleotide
tgccaatctcatcttgttttctgcgcaagttaggttttgtcaagaaagggtgtaacgcaactaagtcatagtccgcctagaagcatttgcggtggacgatggaggggccggactggaggggccggactcgtcatactcctgcttgctgatccacatctgctggaaggtggacagcgaggccaggatggagccgccgatccacacggagtacttg

SEQ ID NO: 10005 - DNA, 214 bp, Artificial Sequence; identical to SEQ ID NO: 9928
  Synthetic polynucleotide

SEQ ID NO: 10006 - DNA, 219 bp, Artificial Sequence
  Synthetic polynucleotide
agaaaaaaagaatgacaaggttcacttttgatgatacggggtgttattaataagacatgtttcctttttggtactagggtgctcctggtgctgtaggtgctcatggtgctgtaggtgcccctggtcctgctggagccacaggtgaccgggtaagcatgcattttcactaagccaacagcaatatctaaaatttcccgccttccctagtcccaaagagcc

SEQ ID NO: 10007 - DNA, 209 bp, Artificial Sequence
  Synthetic polynucleotide
cgaattcgtgctcaaggagggccagctgctgtgcaagggtgactacgagaaggagaaggacctgctcagctccgtgagccccgacgagtccgactccggtactccggtgaggcctggcctgagctgggggcaggcctcagggacgggggttgctggggtgtcctggaggggagtcccggctggagaagccacctcctgcttccaggacc

SEQ ID NO: 10008 - DNA, 218 bp, Artificial Sequence
  Synthetic polynucleotide
cggccagggtgcagtgtcaggacccccccggaagcctcctgggactgtcgctggcacagcccgaggccctgaaggtggcagcacggctcaggtgccagcacggctcaggtgccagcacccacagcatcaccaccgccggagggtccagtgctcactttccagagtgagaagatgaagggcatgaaggagctgctggtggccaccaagatcaactcgag

SEQ ID NO: 10009 - DNA, 207 bp, Artificial Sequence
  Synthetic polynucleotide
ctttaaaatcaattctagcgcctttcttgttcatttttatctcagagcaggagttgttgggggcacctttcgagttctcaaggtaagctgagcttgctcctttctttcttggagggatgaggatcacagagttttgcattaatcttataaagctcgagggctttaatagctgctgcattattatccatacgaagaaaagttggacag

SEQ ID NO: 10010 - DNA, 216 bp, Artificial Sequence
  Synthetic polynucleotide
ccacctccgtcctgaccactggccactccccttccacagaaccacgcctttcgcctgctgaagccggggggcgtcctcacctactgcaacctcacctcctgcaacctcacctcctggggggagctgatgaagtccaagtactcagacatcaccatcatgtttgaggtgcgcccacctgaagttccccatgggtctccaggaagtgaccttggatgg

SEQ ID NO: 10011 - DNA, 209 bp, Artificial Sequence
  Synthetic polynucleotide
gggcggggtgggggcccctgggctcccagggtgggagctggctccgaggctggctggctccgcaggtccgctgacgtcgccgcccagatggcctccaggcctccaggctgaccctgctgaccctcctgctgctgctgctggctggggtatgtggtcccttgtgggatgggggacgggggtggagacgggaggcgggatggtgcggggtg

SEQ ID NO: 10012 - DNA, 216 bp, Artificial Sequence; identical to SEQ ID NO: 9858
  Synthetic polynucleotide

SEQ ID NO: 10013 - DNA, 215 bp, Artificial Sequence
  Synthetic polynucleotide
aatacagcaagtgtgacctgcccctgaggaccctggagagcctgttgagtgggctgggcccagccggcccttttgatatggtgtactggacaggagacatccccgcatccccgcacatgatgtctggcaccagactcgtcaggaccaactgcgggccctgaccaccgtcacagcacttgtgaggaagttcctggggccagtgccagtgtaccctg

SEQ ID NO: 10014 - DNA, 216 bp, Artificial Sequence
  Synthetic polynucleotide
cgaaattgtgtcaacacataaaactagttccgtgtatgtcttctcaattgaatgttttcatcttagggccctgctggccctgctggtgctcccggtcctggtgctcccggtcctgctggttcccgaggtgctcctgtaagttttgtcattttttggttttattttgttttgttctttttttaactcattctacagtgtaggaaatattttattttc

SEQ ID NO: 10015 - DNA, 213 bp, Artificial Sequence
  Synthetic polynucleotide
tctccagccccagctgctcaccatcgctatctgagcagcgctcatggtgggggcagcgcctcacaacctccgtcatgtgctgtgactgcttgtagatggccatggcccatggcgcggacgcgggtgccgggcgggggtgtggaatcaacccacagctgcacagggcaggtcttggccagttggcaaaacatcttgttgagggcaggggagtac

SEQ ID NO: 10016 - DNA, 225 bp, Artificial Sequence
  Synthetic polynucleotide
gcggctcgggcacactggacgtacctgtgggggaaggagctggatgtgcaggccccgcccaccccgccgcaggccacctacggccccgcggtcacgctacctggcgcggctccctggcgcggctcgcggcgtctgggtttgtgttgtcgatggcgacccgtttcccttgcttcagggctgtctcacacgtggtcacacagcgctgccaggagcctagcgtgtcct

SEQ ID NO: 10017 - DNA, 218 bp, Artificial Sequence
  Synthetic polynucleotide
tattctcattgcagtggtcttccaaatatttatgtcaatttcaccccaagctgtacctttgagggagaaaacactgtcatgatgctccagacggctaggtgctccagacggctaggtgagagtcaaatcctcgattcctcccatctgttcataagaatgttctagtccttttcctaggttcttgttcccatggtttttcttcaccgtatatatatatt

SEQ ID NO: 10018 - DNA, 206 bp, Artificial Sequence
  Synthetic polynucleotide
agcaatccagagcggccatcaacaaatgggtgtccaataagaccgaaggccgaatcaccgatgtcattccctcggaagccatcaatgagctcactgttctgttctggtgctggttaacaccatttacttcaaggtactcagaatggccctggagagaccccagggacttcctcttgctcttcagcttaccccctttttttttaaat

SEQ ID NO: 10019 - DNA, 206 bp, Artificial Sequence
  Synthetic polynucleotide
caaaataatcgatcttgttagtaaacgtgatggaaacagctcgctgattgctgccgttgcagaagtaagagttcagaggcggcctctgaagaacagaacagaacaggtaggtgtcaagtgggactagtttgtgtgatgatagtagatgatctcattatactattcaataaagccatcaggtcgagggattatctggcagtgcccta

SEQ ID NO: 10020 - DNA, 206 bp, Artificial Sequence
  Synthetic polynucleotide
agaatgagactctgtctcaaaaacaaacaaaaatttcttttcctaggaactaacaaaacattgtgtctttcttttgaagattatgtgatagaaaagctgggctggagcaatgcgggttctttgacgacaacattagaaaggacacattctttttgacggtccatgatgctatactctatctacagaaccaagtgaaatctcaagag

SEQ ID NO: 10021 - DNA, 217 bp, Artificial Sequence; identical to SEQ ID NO: 9893
  Synthetic polynucleotide

SEQ ID NO: 10022 - DNA, 218 bp, Artificial Sequence
  Synthetic polynucleotide
gggagtctgggcttcaggctgggatggggtctgtggagctgaggcggccccctgcccaccaggtcatggtattcccgggcctgcgtctgagccgtgaagccgtctgagccgtgaagccttcctcaccacggccgaatttgggacccaggagctccggcggcccgcccagctgcggctgcaggtgtaccggctcctcagcacagcaggtgggactctgg

SEQ ID NO: 10023 - DNA, 217 bp, Artificial Sequence; identical to SEQ ID NO: 9884
  Synthetic polynucleotide

SEQ ID NO: 10024 - DNA, 218 bp, Artificial Sequence
  Synthetic polynucleotide
ttcttgtcaaaaagatgctgttggaagcctctacgaagccagaaatgagtactgttatcaacaataccagaggaataattttttatagtgtccctcatcatatagtgtccctcatcatggatcacgtttggctgaatactctgttaatattcgctatcttctcttcccctcgttggaagtcaaagaactcagcaagggtaatactttttgtcataaag

SEQ ID NO: 10025 - DNA, 220 bp, Artificial Sequence
  Synthetic polynucleotide
ctataaattcattaagggagcttgtcctaaaagctatggctttaatgcagcaaggcttgctaatctcccagaggaagttattcaaaagggacatagaaaatcaaaagggacatagaaaagcaagagaatttgagaagatgaatcagtcactacgattatttcggtaactaactaactataatggaattataactaactgaccttaagtttcaaagaaaca

SEQ ID NO: 10026 - DNA, 225 bp, Artificial Sequence
  Synthetic polynucleotide
tggtcaggtcgagggccaggcctcagagcggcccctgtgtccacgcaggtgtttggtcttgggaacaagacctacgagcacttcaatgccatgggcaagtacgtggacaagctacgtggacaagcggctggagcagctcggcgcccagcgcatctttgagctggggttgggcgacgacgatgggaagtgagtgcccaccctgccaccatgatcagcgcggcgggc

SEQ ID NO: 10027 - DNA, 215 bp, Artificial Sequence
  Synthetic polynucleotide
agctagggagcagggctgatgccagagctccgctaaaggctgctctctcaacaagaggaacgatttaagtcttggggcacgccctgccagctcaccttcctgcagccgcacctgctgcagccgcacctgccgcagccgtgggggccccagctctgggctggactggttcccgtggacgtagggcagcagcacgtgggccatccatggccagagct

SEQ ID NO: 10028 - DNA, 218 bp, Artificial Sequence; identical to SEQ ID NO: 9883
  Synthetic polynucleotide

SEQ ID NO: 10029 - DNA, 219 bp, Artificial Sequence; identical to SEQ ID NO: 9852
  Synthetic polynucleotide

SEQ ID NO: 10030 - DNA, 215 bp, Artificial Sequence
  Synthetic polynucleotide
catgaagcgcggcgcatgatcgagggcgtggtgtacgagatgcgcgtctacgcggtcaacgccatcggcatgtccaggcccagccctgcctcccagcccttgcctcccagcccttcatgcctatcggtgagcctgcctggcctggtcctgccccccgccccctccccagttaaaaacctccaataatagcaggtgctctgcaggcagccatgcta

SEQ ID NO: 10031 - DNA, 209 bp, Artificial Sequence
  Synthetic polynucleotide
agattctggaagtcttctctggagatcttctcagattgcatgcccaatcacattgccgttgccctggcagccacccgcgggtccaccctttggcacagcggcacagcggtactgcattcctaatgatgcaggagacacagctgataatagagtgtcacggttgaatcctgaagcccatcctctctcttttgtcaatgataatgatgttg

SEQ ID NO: 10032 - DNA, 205 bp, Artificial Sequence
  Synthetic polynucleotide
aagtggatacctttgggctgagcctctactttccctccaaaataactgcctccgctgtgacctttgatcaccagggaaatgtgattgttgcagatacatctatctggtccagctatcctttgcttaggaaaacctgaggagtttccagtaccgaagcccatggtcactcatggtctttcgcatcctgtggctcttaccttcacca

SEQ ID NO: 10033 - DNA, 212 bp, Artificial Sequence
  Synthetic polynucleotide
ttggcaggactttgaaatggatgtggtggcaatggtgaatgacacggtggccacgatgatctcctgctactacgaagaccatcagtgcgaggtcggcatgaggtcggcatgatcgtgggtaagggctccttgcacccctgccccttccagactgctgaggctccctgtgtacaacaggcttcaagggccctgtggggtgaggaccaaactac

SEQ ID NO: 10034 - DNA, 215 bp, Artificial Sequence; identical to SEQ ID NO: 10027
  Synthetic polynucleotide

SEQ ID NO: 10035 - DNA, 217 bp, Artificial Sequence; identical to SEQ ID NO: 9942
  Synthetic polynucleotide

SEQ ID NO: 10036 - DNA, 204 bp, Artificial Sequence
  Synthetic polynucleotide
tctccatacaggtcttctttggcaatgtggattcatctgggataaaacacaatatttttaaccctccaattattgctcgatacatccgtttgcacccaactactcattatagcattcgcagcactcttcgcatggagttgatgggctgtgatttaaatagtaagtgccaagtcatcccatatccttcttccctcaaccatgggt

SEQ ID NO: 10037 - DNA, 211 bp, Artificial Sequence
  Synthetic polynucleotide
cagtcccctgcgcccaggcctagctactatgggcacccagcctgctacacaccaccccatccccacctacccctcctatgtgccggcggctgcccacgactgcccacgactacagcagcggactcttccaccccggaggcttcctggggggaccggcctccagcttcacccctaagcagcgcagcaaggctcgttcctgttcaggtaaagg

SEQ ID NO: 10038 - DNA, 218 bp, Artificial Sequence; identical to SEQ ID NO: 9848
  Synthetic polynucleotide

SEQ ID NO: 10039 - DNA, 219 bp, Artificial Sequence
  Synthetic polynucleotide
ccttttcccttccacctctttttggcttgtgctcctggcccctgagccctccccacaacctctgtcctccttaggttttcgtcatcgaggtgaagacaaaaggaggatcaaggaggatccaagtacctcatctaccgccgctaccgccagttccatgctttgcagagcaagctggaggagcgcttcgggccagacagcaagagcagtgccctggcctgt

SEQ ID NO: 10040 - DNA, 210 bp, Artificial Sequence; identical to SEQ ID NO: 9974
  Synthetic polynucleotide

SEQ ID NO: 10041 - DNA, 219 bp, Artificial Sequence
  Synthetic polynucleotide
gttaggccacttcactgggtcatgattcacagaccactggttgacaaaaaccacagtgtccttgggaatgtggtagcccaagacagaggtgttggcagtggtggcatgaggtggcatgaggaatagtgacaggcacaaagctggagaagcgcatggcttcataaaggaaggccaggacatagggcaggttgggctggtcacccatacaaggcagacggt

SEQ ID NO: 10042 - DNA, 215 bp, Artificial Sequence
  Synthetic polynucleotide
caatgccaccaaaggctgtgacgagtctgtggatgaggtcacagcaccatgtagctgccaagactgctctattgtctgtggccccaagccccagcccccacgccccagcccccacctcctcctgctccctggacgatccttggcttggacgccatgtatgtcatcatgtggatcacctacatggcgtttttgcttgtgttttttggagcattttt

SEQ ID NO: 10043 - DNA, 206 bp, Artificial Sequence
  Synthetic polynucleotide
tgacccttccttcttgaccccatcgcaggcaggggtgtggggaagaacgaggaactgcgtctttatcaccatctcttcaacaactatgacccaggaagccgagccggccagtgcgggagcctgaggatactgtcaccatcagcctcaaggtcaccctgacgaatctcatctcactggtaagctacccccaccctcatcttaagcca

SEQ ID NO: 10044 - DNA, 218 bp, Artificial Sequence
  Synthetic polynucleotide
gtgacctctcgtgtccccaggacacgctaggctcctggcagcgctgtgtgaccacgtgtgagacagccctgaagcaagggaaacgggtcgccatcgacaacgggtcgccatcgacaacacaaacccagacgccgcgagccgcgccaggtagcgtgaccgcggggccgtaggtggcctgcggcggggtgggcggggcctgcacatccagctccttcccc

SEQ ID NO: 10045 - DNA, 227 bp, Artificial Sequence; identical to SEQ ID NO: 9935
  Synthetic polynucleotide

SEQ ID NO: 10046 - DNA, 219 bp, Artificial Sequence; identical to SEQ ID NO: 10003
  Synthetic polynucleotide

SEQ ID NO: 10047 - DNA, 212 bp, Artificial Sequence; identical to SEQ ID NO: 9981
  Synthetic polynucleotide

SEQ ID NO: 10048 - DNA, 209 bp, Artificial Sequence
  Synthetic polynucleotide
tcctggagttccagccactggccggcaaccttgctctcaccttgctctccccactggcccaggtgcggcagaaggtgcgcatagtgagccgagaggccgagaggccgaggcggccgaggccgaggagccgtggggcgaggaagcccgggaaggccggcggcggggcccacggcgggagtccaagccagaggagcccccgccgcccaaga

SEQ ID NO: 10049 - DNA, 212 bp, Artificial Sequence
  Synthetic polynucleotide
cccctttgactctgtggagccgcctaaaagacccaccagcagactcatcatgcacagcatggccatgttcggaagagagttctgctacgcggtggaggcagggtggaggcagcgtatgtgaccccagtcctgctcagcgtaggtctgcccagcagcctgtacagcattgtgtggttcctcagccccatcctgggattcctgctgcagcccgt

SEQ ID NO: 10050 - DNA, 210 bp, Artificial Sequence
  Synthetic polynucleotide
caagagctgctgcaggcctacggcaaggactacatcgagcacttgcatgggcagttcctgcactcgctacgcctggccatgtccgacctcaccccagttgccccagttgtagatgccatcacagatgcgctgctggcagctcggccccgccgccgctattaccccggccagggcctggggctcatgtacttcatccactactacctgcct

SEQ ID NO: 10051 - DNA, 227 bp, Artificial Sequence
  Synthetic polynucleotide
ctgggaaagcactggagaaatgggatttgtttaaactatgacagcattatttcttgttcccttgtcctttttcctgcaagcaggaagggaacctgattggattaccccttctggattaccccttctgattgacaactatgtgccccctttggagggactgcctatcttcattcttcgactagccactgaggtcagtgatcaagcagatactaagcatttcggtacat

SEQ ID NO: 10052 - DNA, 206 bp, Artificial Sequence
  Synthetic polynucleotide
tcctcttctatgtctcgtggctgcagcaccagcctaggaattcccgggcccgggggccccgtcgtgcctctgctgccggcccccgtgtcaccgtcctggtctggtgcgggagttcgaggcatttgacaacgcggtgcccgagctggtagactccttcctgcagcaagacccagcccagcccgtggtggtggcagccgacacgctcc

SEQ ID NO: 10053 - DNA, 205 bp, Artificial Sequence
  Synthetic polynucleotide
gaaatgtctctcttctattctaggggagtatatctctgaaagaactgaatgcccgacccttagaagttttcatgtgtagtgtgctcaaaagacaaggttacttacggagaaggcttccgctggatggcacagtacattgattaacacaaactcacattggttccaggtctcaacgttcaggcttactcagagatttgattgctca

SEQ ID NO: 10054 - DNA, 218 bp, Artificial Sequence
  Synthetic polynucleotide
tgctgtctcagctggcctcgtcctgggctccgaacatgagacccgtctggtggcaaagctatttaaagactacagcagcgtggtgcggccagtggaagaccgcggccagtggaagaccaccgccaggtcgtggaggtcaccgtgggcctgcagctgatacagctcatcaatgtggtgagacaagagcactgggggcctgcccacacacccacacctct

SEQ ID NO: 10055 - DNA, 210 bp, Artificial Sequence
  Synthetic polynucleotide
tcgggaaaccagagaatatgactttattgctgcacaattcaaatacttttctttctacaacatgtatatagtcacccagaaagcagactacccgaatatcccgaatatccagcacttactttacgacctacacaggagtttcagtaacgtgaagtatgtcatgttggaagaaaacaaacagcttcccaaaatgtggctgcactacttcag

SEQ ID NO: 10056 - DNA, 210 bp, Artificial Sequence
  Synthetic polynucleotide
accctggctatgccatggtgcggctggtcaagtgcgacgtctacccctgccccaacacagtggactgcttcgtgtcccgccccaccgagaaaaccgtcttaaccgtcttcaccgtcttcatgctagctgcctctggcatctgcatcatcctcaatgtggccgaggtggtgtacctcatcatccgggcctgtgcccgccgagcccagcgcc

SEQ ID NO: 10057 - DNA, 209 bp, Artificial Sequence
  Synthetic polynucleotide
tctgtctctttcagtcaggcctgggtctctcaagcttttgtgtctgtgcctgtctgagcccccatgggtgctgcctcttccccctgcaggagactactggactactggattgaccccaaccaaggctgcaccttggacgccatgaaggttttctgcaacatggagactggcgagacttgcgtctaccccaatccagcaaacgttcccaa

SEQ ID NO: 10058 - DNA, 215 bp, Artificial Sequence; identical to SEQ ID NO: 10013
  Synthetic polynucleotide

SEQ ID NO: 10059 - DNA, 215 bp, Artificial Sequence
  Synthetic polynucleotide
acccgcccgcccgcccctatgaccaacatgagctggagcttcctgacgcggctgctggaggagatccacaaccactccaccttcgtgggcaaggtgtggcgggcaaggtgtggctcacggtgctggtggtcttccgcatcgtgctgacggctgtgggcggcgaggccatctactcggacgagcaggccaagttcacttgcaacacgcggcagcca

SEQ ID NO: 10060 - DNA, 206 bp, Artificial Sequence
  Synthetic polynucleotide
tggtggccagcagcagctacaacatggtcatccgggaggacaaccagaccaaccgcctgcaggaggctctgaacctcttcaagagcatctggaacaacagaacaggtttgtggagtgaccgcccaccccctgcgcttgcccaggaggccctggtctgcactgtttatagagaagaaccccgtgcaagcattccagacccctggccg

SEQ ID NO: 10061 - DNA, 209 bp, Artificial Sequence; identical to SEQ ID NO: 10011
  Synthetic polynucleotide

SEQ ID NO: 10062 - DNA, 218 bp, Artificial Sequence
  Synthetic polynucleotide
tctggcaccggaggtggcggcggcggcggcggggcgagcggcgggactagcggcagctgcagccccgcgtcctcggagccgccggctgcgcccgccgaccggctgcgcccgccgaccgcctgcgcgccgagagcccgtcgccgccgcgcctgctggccgcgcactgcgcgctgctgcccaagccgggcttcctgggcgcgggcggcggcggcggcggc

SEQ ID NO: 10063 - DNA, 218 bp, Artificial Sequence; identical to SEQ ID NO: 9862
  Synthetic polynucleotide

SEQ ID NO: 10064 - DNA, 213 bp, Artificial Sequence; identical to SEQ ID NO: 9896
  Synthetic polynucleotide

SEQ ID NO: 10065 - DNA, 218 bp, Artificial Sequence; identical to SEQ ID NO: 10044
  Synthetic polynucleotide

SEQ ID NO: 10066 - DNA, 210 bp, Artificial Sequence
  Synthetic polynucleotide
ttcaccggcctctcggggctccgccgactcttcctcaaggacaacggcctcgtgggcattgaggagcagagcctgtgggggctggcggagctgctggagctgctggagctcgacctgacctccaaccagctcacgcacctgccccaccgcctcttccagggcctgggcaagctggagtacctgctgctctcccgcaaccgcctggcagag

SEQ ID NO: 10067 - DNA, 210 bp, Artificial Sequence
  Synthetic polynucleotide
catgcactggctgtccaccatcatccccacgcaccacatcaacgcgctcatcttcttcttcatcgtcagcaacctcaccatcgacttcttcgccttcttcgccttcttcatcccgctggtcatcttctacctgtccttcatctccatggtgatctgcaccctcaaggtgttccaggacagcaaggcctgggagaacttccgcaccctcac

SEQ ID NO: 10068 - DNA, 220 bp, Artificial Sequence
  Synthetic polynucleotide
ttgatgttgctacccatgttcccctgatattctatgttcctggaaggacggcttcacttccggaggcaggcgagaagcttttcccttacctcgacccttttcccttacctcgacccttttgattccgcctcacagttgatggagccaggtataaaatatgctgaaatgatattgcttgacagtaagatcacctttagtttatatgtgaaccactttattg

SEQ ID NO: 10069 - DNA, 205 bp, Artificial Sequence
  Synthetic polynucleotide
ttttaattgaagtttcctttttttccttgcagaatccaagaaaacaggggcccgaaacccaaggcagtacagcagaattaattacagggctcgtccaactaactggtccctcagtcacacatgccagagattgctcaggaagcaatggaggtaaggggaaaatgaattccatgttcttgaaggaaagattgtaactatgtacatt

SEQ ID NO: 10070 - DNA, 209 bp, Artificial Sequence
  Synthetic polynucleotide
ggtggggggagctgacctagtggaagctgagcctcagtgtccccctccctcagccacccaacctccttcggagcagccgggaacagatggccagctggccagctggccctgatcctgggccccgtgctggccttgctggccctggtggccctgggtgtcctgggcctgtggcatgtccgacggaggcaggagaagcagcgtggcctgca

SEQ ID NO: 10071 - DNA, 219 bp, Artificial Sequence; identical to SEQ ID NO: 9852
  Synthetic polynucleotide

SEQ ID NO: 10072 - DNA, 216 bp, Artificial Sequence; identical to SEQ ID NO: 10014
  Synthetic polynucleotide

SEQ ID NO: 10073 - DNA, 211 bp, Artificial Sequence
  Synthetic polynucleotide
tctaacttttcattgtcctcaaagattaagattcttaaacatgttcctgaaggtgctgagacagagcaaggccttaaacgggagcttcaagttcttaggtattcttaggtacatcatgtattcatatgactactttgtttttttctttaaaaaaaaaattattagtttttatatactccgaattgctacaactagagacaagcatttttcg

SEQ ID NO: 10074 - DNA, 211 bp, Artificial Sequence; identical to SEQ ID NO: 9949
  Synthetic polynucleotide

SEQ ID NO: 10075 - DNA, 217 bp, Artificial Sequence
  Synthetic polynucleotide
cactacctgcagttggccggcgacacggatgaagaactcaacagctgcaccgctgtggactggctggtcctcgccgcgaagcagggccgtcgcgaggctgggccgtcgcgaggctgtgaagctgcttcgccggtgcttggcggacagaagaggtgggtctgtgtgaggcttagaacagcctctggagggttgagcagcttgtaatgctgcttgctaa

SEQ ID NO: 10076 - DNA, 211 bp, Artificial Sequence
  Synthetic polynucleotide
cccggcctggggctctgtgtgtttcagcactctacccagaccctcccggccccagggtccacacgtgctcggccgcaggaggcttcagcaccagcgattaccagcgattacgacgttggctgggagagtcctcacaatggctcggggacgtgggcctattcagcgccggatctgctggggtgagcagagcgagggccccgggcgtctacgc

SEQ ID NO: 10077 - DNA, 212 bp, Artificial Sequence
  Synthetic polynucleotide
ccaggccgccggggaagccatggtgggtgcctcaaggccaccccccaagccgctgcgtccgcggcagctgcaggaggttggccgccagagctcctcggacgctcctcggacagcggcatcgccactggcagccactcctcttactccagcagcctctcgtcctacgcgggcagcagcctggacgtgtggcgggccacagatgaactgggctc

SEQ ID NO: 10078 - DNA, 208 bp, Artificial Sequence
  Synthetic polynucleotide
ccaccacatccacccaggtcatggtgatcaaacgccccggcaggaagcgaaaagctgaggccgaccctcaggccattcccaagaaacggggccgaaagccgaaagccggggagtgtggtggcagccgctgccgccgaggccaaaaagaaagccgtgaaggagtcttctatccgatctgtgcaggagaccgtactccccatcaagaagc

SEQ ID NO: 10079 - DNA, 214 bp, Artificial Sequence
  Synthetic polynucleotide
tacttttccctccccatagttaccgtacacgagaagaaattcaggaagtaagaagtaagagtgaccctattatgcttctcaaggacaggatggtgaacagggatggtgaacagcaatcttgccagtgtggaagaactaaaggtacagtcacttgttcatggtggtttgaaggttggctttaaaagttgccacccctgggtggccacagagtttg

SEQ ID NO: 10080 - DNA, 219 bp, Artificial Sequence
  Synthetic polynucleotide
gggtggcttgcagcctggcccattttccctccccaggagtatggggcacccatcgtggaccccattaacgacatccgcatcattgccgtggtctcggtcattggcgtggtctcggtcactgtgctgctggccatctccctggctggcatggagtgggagtccaaggtgaggaggccatggaggagggggacatggaggtggtcacgtggagaagcgggg

SEQ ID NO: 10081 - DNA, 218 bp, Artificial Sequence; identical to SEQ ID NO: 10008
  Synthetic polynucleotide

SEQ ID NO: 10082 - DNA, 211 bp, Artificial Sequence
  Synthetic polynucleotide
cttcggccggttcaaggtgaacagcgaggaggaggaggaggacgcactgaccctgtcctcggccatgtggttctcctggggcgtcctgctcaactccggcatcggcatcggggaaggtaaggccccgcccggcccgcctggtcccgcctcggccctctagggtctgacagagccccccgcccgcccacaggcgcccccagaagcttctcag

SEQ ID NO: 10083 - DNA, 219 bp, Artificial Sequence; identical to SEQ ID NO: 9937
  Synthetic polynucleotide

SEQ ID NO: 10084 - DNA, 208 bp, Artificial Sequence
  Synthetic polynucleotide
gatggacatccattcctggctgtattcatgtgttgttgttgttattgttttaattgttcttatttacatgcaggttattggttgaattcccagcaacaggcaacaggtggtgtgattccatcttggcaatttcagcctttaaagctgatccgatatgtcacaacttttgatttcttcctggcagcctgtgagattatcttttgtttct

SEQ ID NO: 10085 - DNA, 214 bp, Artificial Sequence; identical to SEQ ID NO: 10004
  Synthetic polynucleotide

SEQ ID NO: 10086 - DNA, 212 bp, Artificial Sequence
  Synthetic polynucleotide
catgatttcctgctggttccccgagagctgagtggctcctccccagtcctggaggagactcacccagctcaccagcagggagccagcagaccagggccccaccagggccccgggatgcccaggcacaccccggccgtcccagagcagtgcccacacagtgcgacgtcccccccaacagccgcttcgattgcgcccctgacaaggccatcacc

SEQ ID NO: 10087 - DNA, 219 bp, Artificial Sequence; identical to SEQ ID NO: 9937
  Synthetic polynucleotide

SEQ ID NO: 10088 - DNA, 212 bp, Artificial Sequence
  Synthetic polynucleotide
gccactggacacaggataaggcccagcgcacaggcccccacgtggacagcatggaccgcggcacgctccctctggctgttgccctgctgctggccagctgctggccagctgcagcctcagccccacaagtaggtgtccagggacccagggtggggagactcggcctccggtgcacggaccaggccccaagtattcccggcctccttcctgta

SEQ ID NO: 10089 - DNA, 221 bp, Artificial Sequence
  Synthetic polynucleotide
gcttagggaatagaaagtggtgtagagaatataacttcaattacttctttcatcatttttcttcctttagtccacaagccctagccatgccgtggtagccaatgttcagccaatgttcagcttgtcttgcatctaatgaagcaacacagtaaagctttgtgcaatgatcgagtcatcaacagtattcctttggcaaagcaagtatcttcacgaggtggtaa

SEQ ID NO: 10090 - DNA, 209 bp, Artificial Sequence
  Synthetic polynucleotide
gttcctcattatatagaatgagagaacatcatttctctccttttcctcccaggtggccgtcgaggaccgagtcaggcagctgcatgaagcccacagggactcagggactttggtccagcatctcagcactttctttccagtaagtcattttcagcttttatcacttaactttattgcatcttgattaataagaataacagttgaaaaaa

SEQ ID NO: 10091 - DNA, 207 bp, Artificial Sequence
  Synthetic polynucleotide
agttcattggaacagaaagaaatggatttatctgctcttcgcgttgaagaagtacaaaatgtcattaatgctatgcagaaaatcttagagtgtcccatctgcatctggtaagtcagcacaagagtgtattaatttgggattcctatgattatctcctatgcaaatgaacagaattgaccttacatactagggaagaaaagacatgtc

SEQ ID NO: 10092 - DNA, 205 bp, Artificial Sequence
  Synthetic polynucleotide
accatgagtgactgtctttagtcaaaaaccctccccacctgaagtagcactttcattaccctagagtcaccatcctggtaaatagagggttcgttcccaggcaggaagaaagtgaatcctgaaacccggcagaaaggccaggtaagggacatggactcttcctactttagagaaggctctgggagtccaccaggctccatgcaat

SEQ ID NO: 10093 - DNA, 205 bp, Artificial Sequence
  Synthetic polynucleotide
gatggttatggtaaaagaggtcaaatgaaaccctcgattgaatcctattctgaagatgatgaaagtaagttttgcagttatggtcaatacccagccgaccgacctagcccataaaatacatagtgcaaatcatatggatgataatgatggagaactagatacaccaataaattatagtcttaaatattcagatgagcagttgaac

SEQ ID NO: 10094 - DNA, 207 bp, Artificial Sequence
  Synthetic polynucleotide
ataattttttggcatgtttacccaggtacccagaagctattactgaccctgcctacaaaggacagattctcacaatggccaaccctattattgggaatgggaatggtggagctcctgatactactgctctggatgaactgggacttagcaaatatttggagtctaatggaatcaaggtagtaccagtggtggccatttaaaaagtct

SEQ ID NO: 10095 - DNA, 211 bp, Artificial Sequence; identical to SEQ ID NO: 10037
  Synthetic polynucleotide

SEQ ID NO: 10096 - DNA, 221 bp, Artificial Sequence
  Synthetic polynucleotide
tagcccctgctcggccttcgagttccactgcctaagtggcgagtgcatccactccagctggcgctgtgatggtggccccgactgcaaggacaaatctgacactgcaaggacaaatctgacgaggaaaactgcggtatgggcggggccagggtgggggcggggcgtcctatcacctgtccctgggctcccccaggtgtgggacatgcagtgatttaggtgcc

SEQ ID NO: 10097 - DNA, 209 bp, Artificial Sequence
  Synthetic polynucleotide
ttccttcttcaactagattacagatctgcttgatgttgtactagacagtttcatcaaaaccagtgcaacaggtggcttgggatcaataaaagctgaggtgctgaggtgatggcagatactgctgtagctttggcttctggaaatgtgaaattggtttcaagcaaggtaatcacttttcttttgccttctgtactatagcatatctgttt

SEQ ID NO: 10098 - DNA, 209 bp, Artificial Sequence
  Synthetic polynucleotide
ggcgataggccacggccatgtggtactggctcatggcccggtacttcaggctccagcctttgccatagttgttgacaagctctgccgccttgcaggggaagaacagaacagggctttctcgtagtcctgcaggggacatggaatggaaggaggcaaactgagtggcagaggctgccccaagtcaagggctcctgggctaggtttctcta

SEQ ID NO: 10099 - DNA, 205 bp, Artificial Sequence
  Synthetic polynucleotide
cagggtcgtcagacaccaaaacatatttctgaaagtctaggagctgaggtggatcctgatatgtcttggtcaagttctttagctacaccacccacccttacttagttctactgtgctcataggtaataatagcaaatgtgtatttacaagaaagagcagatgaggttgataattgtcatctctaatacttctgttaaaaggaaat

SEQ ID NO: 10100 - DNA, 205 bp, Artificial Sequence
  Synthetic polynucleotide
gaccctcatgccaccccactgcaggagacgcttcatctgaaggaaaaggagggctgcccccaggccttccacgccctcctgtcctggctgctgacccaggcaggactccacagccatcctggacttctggagggtgctgttcaaggactacaacctggagcgctatggccggctgcagcccatcctggacagcttccccaaaggt

SEQ ID NO: 10101 - DNA, 209 bp, Artificial Sequence
  Synthetic polynucleotide
aggagcttcaaggaggctttgcggggcagagctggggctgggtgcagcctgaggtgtccacctggccttcccaggccccctgctgccataccaagccgagaagccgagttcctggtgcgcagccacgatgcggaggaggtgctgccctcaacacctgccagccgcttcctctcagccttggggggactctgggagcccggagagcttca

SEQ ID NO: 10102 - DNA, 209 bp, Artificial Sequence
  Synthetic polynucleotide
ccctaggagggacttcccaaccctgacaggcggcgggcaggtgggcagggcctcgcagtccagcttccccaccttgtctgcctccacagggggactccgggactccggcagccccttggtctgcaacgggctaatccacggaattgcctccttcgtccggggaggctgcgcctcagggctctaccccgatgcctttgccccggtggcac

SEQ ID NO: 10103 - DNA, 209 bp, Artificial Sequence
  Synthetic polynucleotide
gctttggcccttggtgataggtggctcggcccgccctacctggcaccctgaccctggtcacggcctctccctccagcaggatacagacgtccctcaccagctcaccagtgccagcttggggtctgcagatgagaactccgtggcccaggctgacgatagcctgaaaaacctccacctggagctcacggaaacctgtctggacatgatgg

SEQ ID NO: 10104 - DNA, 215 bp, Artificial Sequence; identical to SEQ ID NO: 10030
  Synthetic polynucleotide

SEQ ID NO: 10105 - DNA, 215 bp, Artificial Sequence
  Synthetic polynucleotide
aaaatagcccagtataagcgggagtgcccgtccatctttgcttgggaaatccgagacagattactgtccgagggggtctgtaccaacgataacataccaaggataacataccaagcgtaagttcattgagaacatctgccctccctgccctaagcccaatgctctctcctctttacctcctcccaccctctctctccactgtctcttagtctgtg

SEQ ID NO: 10106 - DNA, 212 bp, Artificial Sequence
  Synthetic polynucleotide
acctcaagaaggccctgctcctccagggctccaacgagatcgagatccgcgccgagggcaacagccgcttcacctacagcgtcactgtcgatggctgcacgatggctgcacggtgagtgcccagaatccccaggcagggccccacctctccggccttgggctttttggccaggccatagtgccctctctccatcactcccacgtggtaatgc

SEQ ID NO: 10107 - DNA, 209 bp, Artificial Sequence
  Synthetic polynucleotide
gtgatcccggtgggcattgggccccatgccaacctcaagcagatccgcctcatcgagaagcaggcccctgagaacaaggccttcgtgctgagcagtgtggaagtgtggatgagctggagcagcaaagggacgagatcgttagctacctctgtgaccttgcccctgaagcccctcctcctactctgccccccgacatggcacaagtcact

SEQ ID NO: 10108 - DNA, 212 bp, Artificial Sequence
  Synthetic polynucleotide
ggatactgcacggacttccaggcagtgccaggctgtggaattgggtgcaaagtcagcaacgtggaaggcatcctggcccacagtgagcgccctttgagtgccctttgagtgcaccggccagtcacctgaatgaggctggcagccttcccgcagaaaaaggtattgctggcttttgtctctgcagctggttaaaagtagaggtgggtcaaacc

SEQ ID NO: 10109 - DNA, 209 bp, Artificial Sequence
  Synthetic polynucleotide
gacttagcatgttttcctttaacatttttctagaaaacagaatcttggcattgtcttcctcaagaaatggactcttcccaaaccttggatacatcccagactagactaggtttaatgtgagaacggaagatactgaagtgacagacttcccctctctggaggagggcatattgacgcaatcagaaaatcaagtaaaggaacccaacaga

SEQ ID NO: 10110 - DNA, 217 bp, Artificial Sequence
  Synthetic polynucleotide
cagagggcagaggcctagcaactgcccctccccctgcagcagtggtgcgactatcgcctgcgctgggatccgcgagactacgaaggcctgtgggtgctgagggtgccgagggtgccgtccaccatggtgtggcggccggatatcgtgctggagaacaagtgaggagggggtgcaggcaggggtgtgggggacaaaggacacagggtctgggcccagc

SEQ ID NO: 10111 - DNA, 212 bp, Artificial Sequence
  Synthetic polynucleotide
cccccaggcctgggggcagaatctgccataaccagcttcgtgtctccagggcggcgtgatggatgacaagagtgaagattccatgtccgtctccaccttgtctccaccttgagcttcggtgtgaacagacccacgatttcctgcatattcgactgtaagtgaggcttcgaggcctctatggggtgataagggtgtgtcaccttatgcttctg

SEQ ID NO: 10112 - DNA, 209 bp, Artificial Sequence
  Synthetic polynucleotide
aaaatcactgtaaagacatgtggttctttatttataggcattttggaactgggtagaaaattatccagatgaatttacaaaactgtaccagatcccacagtcccacagactgatatggctggtaaggatacgattgattttttttttttttttgtcttttaaatgcctacttgtgacataaaaacctatcatcgttttccaagttattt

SEQ ID NO: 10113 - DNA, 207 bp, Artificial Sequence
  Synthetic polynucleotide
ttattattagaaaaataatgagctcagtatttaccaagacagatccttcctgtggcatccaaagtcattccactgggacactgacacttgaatgaccccctagctagtgttaacacacaggccatttttacacactcctgggaacacttcacattcatctatatctaaaaagaaaaaaaaagtataaagttaatatatctttataat

SEQ ID NO: 10114 - DNA, 212 bp, Artificial Sequence; identical to SEQ ID NO: 10077
  Synthetic polynucleotide

SEQ ID NO: 10115 - DNA, 214 bp, Artificial Sequence
  Synthetic polynucleotide
cgtacacgagaagaaattcaggaagtaagaagtaagagtgaccctattatgcttctcaaggacaggatggtgaacagcaatcttgccagtgtggaagaacagtgtggaagaactaaaggtacagtcacttgttcatggtggtttgaaggttggctttaaaagttgccacccctgggtggccacagagtttgtgtgggttcctccaagcccagaa

SEQ ID NO: 10116 - DNA, 208 bp, Artificial Sequence
  Synthetic polynucleotide
tcacagagtatcatgtctcccttgttgctcctttcaggtaaagaagcagattttagatgaaaagatctactgccctcctgaggcttctgtgctcctggctcctggcttcttacgccgtccaggccaaggtaggctcaaagaagaaaaatgtatttttcctgggcgttaatttgggtcatgggatcactcctatcttctctttctttgg

SEQ ID NO: 10117 - DNA, 219 bp, Artificial Sequence; identical to SEQ ID NO: 10039
  Synthetic polynucleotide

SEQ ID NO: 10118 - DNA, 209 bp, Artificial Sequence
  Synthetic polynucleotide
tttagactccagaactccccacttgccgcgttctcgccgccgcaggctcccgggacgatggtgccccgcctgctgctgcgcgcctggccccggggccccggggccccgcggttggtccgggagcccccagtcggcccctcagcgccggctccgggcccggccagtacctgcagcgcagcatcgtgcccaccatgcactaccaggacagc

SEQ ID NO: 10119 - DNA, 211 bp, Artificial Sequence
  Synthetic polynucleotide
gagaagaatggaaataaccgaaagctgcgggtttgtgttgctacttgtaaccgtgcagattattctaaacttgccccgatcatgtttggcattaaaaccgattaaaaccgaacctgagttctttgaacttgatgttgtggtacttggctctcacctgatagatgactatgggtaagatgaaagcattttcttattcttcattgcaacagtg

SEQ ID NO: 10120 - DNA, 209 bp, Artificial Sequence
  Synthetic polynucleotide
atgcttatggacaaaaatgctacagctttgaggctaaatcatatgtcaaataaaactacttcatcaaaaaacatggaaatggtccaacagaaaaaagagggaaagagggccccattccaccagatgcacaaaatccagatatgtcgttctttaagatgctattcttgccagaatcagcaaggtggatacaaaggactcatggaaagaac

SEQ ID NO: 10121 - DNA, 218 bp, Artificial Sequence; identical to SEQ ID NO: 9849
  Synthetic polynucleotide

SEQ ID NO: 10122 - DNA, 204 bp, Artificial Sequence
  Synthetic polynucleotide
ggtttcgagtcaggggaggtcacaccggaccagatcacctgctctaacccggagcagtatgtgggctggtattcttcgtggactgcaaacaaggcccggctgctcaacagtcaaggctttgggtaagcagggcccggggattttttttcatgtgcttttaaaaaaaaataggcctctctaccagcgtggccaacacagtgaaac

SEQ ID NO: 10123 - DNA, 214 bp, Artificial Sequence
  Synthetic polynucleotide
tccatcctccccttccctctgactcttctcttttcccagcctacctctcctctcccctggccctgcccagccagaggaggagcccccccgaggagccaccccgaggagccacctgacttctgctgtcccaagtgccagtatcaggcccctgatatggacaccctgcagatacatgtcatggagtgcattgagtagggccggccagtgcaaggcc

SEQ ID NO: 10124 - DNA, 205 bp, Artificial Sequence
  Synthetic polynucleotide
agagtgcagccgccgcccacccgacgccaggcctcgctccccgcctggcctgtccgcttcagtgttccatccgcgtctgtctccccgcaggccccggacggacggtgacggtgaaggtggaactgagctgcgcacccggggatctcgatgccgtcctcatcctgcagggtcccccctacgtgtcctggctcatcgacgccaacca

SEQ ID NO: 10125 - DNA, 208 bp, Artificial Sequence
  Synthetic polynucleotide
acagggtgggccatcatgagacataatgatctcatccccccctaagagctggctgtacctgaaaggatcatacatgcgctgtgaccgcaagatggaggtgggaggtggcgttcatggtgtgtgccatcaacccttccattgacctgcacaccgactcgctggagcttctgcagctgcagcaggtgagggctgagccaatggggcagga

SEQ ID NO: 10126 - DNA, 217 bp, Artificial Sequence; identical to SEQ ID NO: 9926
  Synthetic polynucleotide

SEQ ID NO: 10127 - DNA, 218 bp, Artificial Sequence; identical to SEQ ID NO: 9944
  Synthetic polynucleotide

SEQ ID NO: 10128 - DNA, 212 bp, Artificial Sequence
  Synthetic polynucleotide
caggatctggcaagtctgaaaatccctgagcaatttcgacatgcgatctggaagggcatcctggaccaccggcagctccacgaattctcctccccttctcctccccttctcatctcctgcggaccccaagcagtgcctctacagtcagtgtgggctccagtgagacccggggtgagcgtgttattgatgctgtgcgattcaccctccgccag

SEQ ID NO: 10129 - DNA, 214 bp, Artificial Sequence; identical to SEQ ID NO: 9967
  Synthetic polynucleotide

SEQ ID NO: 10130 - DNA, 218 bp, Artificial Sequence
  Synthetic polynucleotide
gtgagtcagtgtgcagcatttgaaaaccccaagggactaattcatggttgttccaaagataatagaaatgacacagaaggctttaagtatccattgggacaaagtatccattgggacatgaagttaaccacagtcgggaaacaagcatagaaatggaagaaagtgaacttgatgctcagtatttgcagaatacattcaaggtttcaaagcgccagtca

SEQ ID NO: 10131 - DNA, 208 bp, Artificial Sequence
  Synthetic polynucleotide
tctctctgcctattggtctattttcccacccttaggctgctggtggtctacccttggacccagaggttctttgagtcctttggggatctgtccactcctgactcctgatgctgttatgggcaaccctaaggtgaaggctcatggcaagaaagtgctcggtgcctttagtgatggcctggctcacctggacaacctcaagggcaccttt

SEQ ID NO: 10132 - DNA, 219 bp, Artificial Sequence
  Synthetic polynucleotide
tctctttgtcctgactgctcaaatcccatgttttcaggatttatcagtcttgtactaaggcatggaacttttagccattctgcagttttcatgggtatgtcctcatgcatcctcatgcaccaaaatgattggttccacagaatcttcaagtaagtcattaaggtcatcaactttaatgtcacaataacagcattcgtgaattggcttcatgataagttt

SEQ ID NO: 10133 - DNA, 205 bp, Artificial Sequence
  Synthetic polynucleotide
tcgctgctatacactgacctgtctcataaaaagggggactctatagtctattgacgttttcttttccatgtgcagaaggaggcaatgtatatgcaactggttggtggaaataatgaaggacagttggggcttggtgacaccgaagaaagaaacacttttcatgtaattagcttttttacatccgagcataagattaagcagctgt

SEQ ID NO: 10134 - DNA, 205 bp, Artificial Sequence
  Synthetic polynucleotide
acgagtttcgctgccacgatgggaagtgcatctctcggcagttcgtctgtgactcagaccgggactgcttggacggctcagacgaggcctcctgcccggtcggtgctcacctgtggtcccgccagcttccagtgcaacagctccacctgcatcccccagctgtgggcctgcgacaacgaccccgactgcgaagatggctcggatg

SEQ ID NO: 10135 - DNA, 206 bp, Artificial Sequence
  Synthetic polynucleotide
gaagctccttgtcaagatgccttttcaaacttcgccagggggcaaggctgaggggggtggggccaccacatccacccaggtcatggtgatcaaacgccccgccccggcaggaagcgaaaagctgaggccgaccctcaggccattcccaagaaacggggccgaaagccggggagtgtggtggcagccgctgccgccgaggccaaaaa

SEQ ID NO: 10136 - DNA, 209 bp, Artificial Sequence; identical to SEQ ID NO: 9989
  Synthetic polynucleotide

SEQ ID NO: 10137 - DNA, 209 bp, Artificial Sequence
  Synthetic polynucleotide
cagggccatgatgcctgttcctccccacacccctcgccctcctggctggcgccgccagattgaccaagtctccctcccgtcctcccccagaaaaaggtgcaaaggtgcactgcctcaacatggacagcctctctttccagctgggcctctacctcagcccacacttcctccaggcctccaacaccatcgagccggggcagcagagcttt

SEQ ID NO: 10138 - DNA, 212 bp, Artificial Sequence
  Synthetic polynucleotide
ggtgcccattgtgtccttggagtgtgtgtcctgcaaggcacaggccgtgtacgaagtgagccgcagctcctacgtgtacttggagggccgctgcctcaattttgcctcaattgcagcagcggctccaagcgaggggtgagtgttgagcggggtgtgggcgggctggggatgggtcccatggccgaggggacggggcctgcaggcagaagtgg

SEQ ID NO: 10139 - DNA, 210 bp, Artificial Sequence
  Synthetic polynucleotide
gctcaatggaaatctgcgtgataaaggtggagatcaaggacctgaacgacaatgcgcccagtttcccggcagcacagatcgagctggagatctcggaggcatcggaggcagccagccctggcacgcgcatcccgctggacagcgcttacgatccagactcaggaagctttggcgtgcagacttacgagctcacgcccaacgagctgttcg

SEQ ID NO: 10140 - DNA, 212 bp, Artificial Sequence
  Synthetic polynucleotide
tccctgagtgcctgcaggctgacatctgcctgcacctgaaccgctcactgctgcagcactgcaaacccttccgaggggccaccaagggctgccttcgggccgccttcgggccctggccatgaagttcaagaccacacatgcaccgccaggggacacactggtgcatgctggggacctgctcaccgccctgtacttcatctcccggggctcca

SEQ ID NO: 10141 - DNA, 215 bp, Artificial Sequence; identical to SEQ ID NO: 9933
  Synthetic polynucleotide

SEQ ID NO: 10142 - DNA, 205 bp, Artificial Sequence
  Synthetic polynucleotide
gaggcctgtcctgcactgtgtgcatcccctagatttggagatggctatatcgtcacaatgaagatcaaatccccgaaggacgacctgcttcctgacctgaatgaaccctgtggagcagttcttccaggggaacttcccaggcagtgtgcagagggagaggcactacaacatgctccagttccaggtctcctcctcctccctggcg

SEQ ID NO: 10143 - DNA, 210 bp, Artificial Sequence
  Synthetic polynucleotide
tagagtgagaggcgggctgacttctggtcatggccgtggcgcgtgagcccatcttctctttcctcagtgcctttgtggtggagcggcagccctgcatgccctgcatgcccatgcatcctgaccggcccctcgtcatcaagaccggcgtccagttcactactaaagtcaggtaggccatgccacttccatttccagtagagattttactga

SEQ ID NO: 10144 - DNA, 205 bp, Artificial Sequence
  Synthetic polynucleotide
tgtgaactttaaaaaatttcaggcctcccgaggagcccagacagctgcagccacagctccccgtatcaagaaatttgccatctatcgatgggacccagacagacaaggctggagacaaacctcatatgcagacttatgaagttgaccttaataagtgagtatctctgtgaaagccagctattgaaggagagttcttgatttgatt

SEQ ID NO: 10145 - DNA, 217 bp, Artificial Sequence
  Synthetic polynucleotide
tttaagtgaggatgtgtgaggcatcccacctcctacaccacaccaacagcatgacctctctctctgtttcaggactcatatccaggctcaaatatccagtggctcaaatatccagtgtctcaacaaaacaagaatgcaccttccactgcaggcctgggatacggtaactccttatttctctggggtagggtggactggccagttgcaaaaactacct

SEQ ID NO: 10146 - DNA, 207 bp, Artificial Sequence
  Synthetic polynucleotide
cgtcatttgctgtggattattaaggtctaccaggtccagaaggtcctccaggtctccctggaaatggaggtattaaaggagagaagggaaatccaggccaaccaacctgggctacctggcttgcctggtttgaaaggagatcaaggaccaccaggactccaggtaggaaatggaagtagatatctgatgagagaagaatgtgggtgt

SEQ ID NO: 10147 - DNA, 209 bp, Artificial Sequence
  Synthetic polynucleotide
taaattctggattccttttaggccaccaccacctatcatgacagatggtgaagatgcggattacactcattttacaaaccagcagagttccacacggcatcacggcatttctcaaaatcagagtcctctcataaaggtaagaagagtatgtatggtcaagtttaggatcttctttttttatataagcctcgtgttgtagtggaaaaatc

SEQ ID NO: 10148 - DNA, 214 bp, Artificial Sequence
  Synthetic polynucleotide
gcaggtgagcacctggggtgttgcctgtaccaggtgaaccccccagacctgatgagctgcctgactagccgcaccctcatcacccgcggggagacggtgtggggagacggtgtccaccccactgagcagggaacaggcactggacgtgcgcgacgccttcgtaaaggtgggctggagggaaggggccgcttgctcgccctaccccttgggaagt

SEQ ID NO: 10149 - DNA, 218 bp, Artificial Sequence; identical to SEQ ID NO: 10062
  Synthetic polynucleotide

SEQ ID NO: 10150 - DNA, 211 bp, Artificial Sequence
  Synthetic polynucleotide
tcatcttactagcctcaaacatatcttctttgccaggactcgcctctgcacaaagccctcttttgggtagctgtggctgtgctgcagcttgatgaggtcagatgaggtcaacttgtattcagcaggtaccgcacttcttgaacaaaacctgcatactttagatagtctccgtatattcaatgacaaggtaagcaaactttgccttgaggtt

SEQ ID NO: 10151 - DNA, 216 bp, Artificial Sequence
  Synthetic polynucleotide
ggttggcagtttctgatgtttttcttcatcttggatattgtaggtgccactcccgggagagccaggcagccatggcgggtcaggaggagacgtctcaggaggagacgtctcaggatgagacctatgaagtgaagatgaaccatgacacggaggcctgcagtgagcccagcctgctctccacagagatgtgagctctgctgccctctgctgaggctg

SEQ ID NO: 10152 - DNA, 210 bp, Artificial Sequence
  Synthetic polynucleotide
gcgccggacgccacttccggtccccgtggtcacgtgaccgtcacttcacgtgaccgcgcggcggccgctgcggcgcgatggcggcggggctggcgcggctggcgcggctcctgttgctcctcgggctctcggccggcggtgagtggcccggccgtccgcgtccccaggccccgcgcgcgctctgcaccccggcctccccgctcacggtct

SEQ ID NO: 10153 - DNA, 212 bp, Artificial Sequence; identical to SEQ ID NO: 9973
  Synthetic polynucleotide

SEQ ID NO: 10154 - DNA, 207 bp, Artificial Sequence
  Synthetic polynucleotide
ggccgggcctacggcttggggcggccgggcccggcggcgggctgtgtccgcggggagcgtccaggctgggccgcaggaccgggcgcggagcctcgcaggggcagggtcgggctcgggctccctaaccgtctccgcttcttccgccagtcggtggccgggctggcggcgcggttgcagcggcagttcgtggtgcgggcctggggctgc

SEQ ID NO: 10155 - DNA, 206 bp, Artificial Sequence
  Synthetic polynucleotide
tatgtcttccacccttgactctcaggatagtgcagcaggatgcagcggaacccccccgatttgccgacaagcccagaccaaactagaagtggccctgtactgtacatgtttctgtggaaccctgacactgaagctgttctggttgccatgtcctgtttccgccacctctgtgaggaagcagatatccggtgtggggtggatgaagt

SEQ ID NO: 10156 - DNA, 216 bp, Artificial Sequence
  Synthetic polynucleotide
gcttattgggtaattctttgggattctctattggagtaggtactacgagactggcagcatccggcctggagtgatagggggctccaagcccaaggtggccaagcccaaggtggccacccccaaggtggtggagaagattggggactacaaacgccagaaccctaccatgtttgcctgggagatccgagaccggctcctggctgagggcgtctgtga

SEQ ID NO: 10157 - DNA, 213 bp, Artificial Sequence
  Synthetic polynucleotide
cttgtatgggtgaccagcccaacctgccctatgtcctggccttcctttatgaagccatgcgcttctccagctttgtgcctgtcactattcctcatgccacccctcatgccaccactgccaacacctctgtcttgggctaccacattcccaaggacactgtggtttttgtcaaccagtggtctgtgaatcatgacccagtgaagtggcctaacc

SEQ ID NO: 10158 - DNA, 205 bp, Artificial Sequence
  Synthetic polynucleotide
ggcatttctgccaccctccctctgctttacaatcaggctctcctccttcagatgagatccgcaccctccgagaccagttgcttttactgcacaaccagttagttactctatgagcgttttaagaggcagcagcatgccctccggaacaggcggctcctccgcaaggtgatcaaagcagcagctctggaggaacataatgctgcca

SEQ ID NO: 10159 - DNA, 214 bp, Artificial Sequence; identical to SEQ ID NO: 9928
  Synthetic polynucleotide

SEQ ID NO: 10160 - DNA, 205 bp, Artificial Sequence
  Synthetic polynucleotide
atggccattttatcctctgactttctgactttggatttgtctctctttccaggtagatgaagagtacaagaatcctcacacagtagaccgagttcctatggatggggaaggtgcctcatctgtggggccaatccttgtacatcctcagctcgctgttggcagaggtaggggcttagtggcctcacagactggaaaccatgtgatt

SEQ ID NO: 10161 - DNA, 206 bp, Artificial Sequence
  Synthetic polynucleotide
ctgcagcttgtccctggccagggggcacccggcaggcctggtgagggcctccagcccccattgccacccctcactgtctgggtgtgctcactctgccaggccagggcctgcggtccaatgtcctcttgtcttttgatgacacccccgagaaggacagcttcagggcccggagtactagtctcaacgagagacccaagaggtacggc

SEQ ID NO: 10162 - DNA, 208 bp, Artificial Sequence
  Synthetic polynucleotide
gcccaagtgactgacatcaactccaagggattggaattgaggaagactgttactacagttgagactcagaacttggaaggcctgcatcatgatggccaatggccaattctgccataagccctgtcctccaggtatgttacacaaaacatccagagattacagtgaaagtcacagttaggagtagcacatagtaatcatgactataata

SEQ ID NO: 10163 - DNA, 209 bp, Artificial Sequence
  Synthetic polynucleotide
ggcagaggaaggcaggagcagaggctaagccgctcatccccagggcaggtgtagacgcagtgctcccccggcccaggcttcctgaactactacgatgcctgctctgctcggagggtctgcgcgccgccagccccgccctgcggctgggaggccccggcgactccttccacaccccaccgcgatccccgctgagctggggcctcctgcgc

SEQ ID NO: 10164 - DNA, 207 bp, Artificial Sequence
  Synthetic polynucleotide
tgggtgccactggggcgaaggcctggccatctcctgaccctcctctcccacctgcagacgtacaacaccaatgcccaggtccctgacagtgccggcaccggcaccgccaccgcctacctgtgtggggtgaaggccaatgagggcaccgtgggggtaagcgcagccactgagcgttcccggtgcaacaccacccaggggaacgaggtc

SEQ ID NO: 10165 - DNA, 213 bp, Artificial Sequence
  Synthetic polynucleotide
cgcggcggccaaagctggcatgaaccgggtattcctgcagcggctcctgtggctcctgcggctgctgttcccccgggtcctgtgccgggagacggggctggagacggggctgctggccctgcactcggccgccttggtgagccgcaccttcctgtcggtgtatgtggcccgcctggacggaaggctggcccgctgcatcgtccgcaaggaccc

SEQ ID NO: 10166 - DNA, 216 bp, Artificial Sequence
  Synthetic polynucleotide
aaggggtgtgggccttttgggcagagcaggaagatctgcctatgacttctgcttaccacttcccaggcctcctgtgtcacctggatgacgcctgtgtcagcgacgcctgtgtcagcaacccctgccacgaggatgctatctgtgacacaaatccggtgaacggccgggccatttgcacctgtcctcccggcttcacgggtggggcatgtgaccagg

SEQ ID NO: 10167 - DNA, 210 bp, Artificial Sequence; identical to SEQ ID NO: 10139
  Synthetic polynucleotide

SEQ ID NO: 10168 - DNA, 208 bp, Artificial Sequence
  Synthetic polynucleotide
tgcttcaaagcttctctcgtcagaagcctggggctcactcatcccgtcaagcctacggggcctccctgtacgagcagctggtgtgggaacgtcagttaggagttaggacttcccctctacctgtgggctaccaaggccctggaggagctggcctgcaagtgaggaggctgagggcccagggcggggaggcagtgggagtagcacactt

SEQ ID NO: 10169 - DNA, 219 bp, Artificial Sequence
  Synthetic polynucleotide
ccctgcccaggagcagagacccagcggggagttaccatctgaacctctccagccacttccgctggtcggcgctgcaggtgtccgtgggcctgtacacgtccgtgggcctgtacacgtccctgtgccagtacttcagcgaggaggacatggtgtggcggacagaggggctgctgcccctggaggagacctcgccccgccaggccgtctgcctcacccgcc

SEQ ID NO: 10170 - DNA, 208 bp, Artificial Sequence
  Synthetic polynucleotide
aatgctgaccaaagacctcatgattcccacagttttcaggcaaagggaatatggaaaaagccagaagaaatgcccacagcctgcccaggccacagtccacagtccacgtagtcaaatggctctcactggaatctctcctcccttggcacaaagtcctccagaggtccctaaacaacagctcttgagttatgagttaggtcaaggtcat

SEQ ID NO: 10171 - DNA, 225 bp, Artificial Sequence
  Synthetic polynucleotide
agggcctgcaggcacgtggcactcagaagacgtttatttattctttcagaggctgaggctgcagtggccacccaggagacatccaccgtcaggctaaaggtcagctccacaggtcagctccacagccgtaaggacacagcacacaaccacccgacctgttcccgacacctcccggctgcctggggccacccctgggctcaccacggtggagatagtgacaatgtc

SEQ ID NO: 10172 - DNA, 225 bp, Artificial Sequence
  Synthetic polynucleotide
ctgggtgggggcgggtggcagggcctcttcctcactcatttcattgtcatctgcattcccccagggcttcagtttccacctggctgcggtcctgctgtccctggcttttatccctggcttttatcacttacgtggagcatggtgagtgcagggcccagcccagccgttggatagaaggttggtgggggggctggagacagcctcccctgaggctaacctgacccc

SEQ ID NO: 10173 - DNA, 205 bp, Artificial Sequence
  Synthetic polynucleotide
gtgacagctttctctgccccctgccaggtgaatgtgatgccctctgccagccgggtgatcctcctggagaacctgacccgcttctggcccatcatccagatagatccgcataaagcgctgccagcaggtggggccagggatgtggggtgtggccctgggtagggggctctgagccccataaacaggcagatcttaagccagagga

SEQ ID NO: 10174 - DNA, 207 bp, Artificial Sequence
  Synthetic polynucleotide
gcaaaactccatctcaaaaaaaagcgggaggggaaataatttgctgtttcttccttcccttcctcagaatgactgatggatactcaggaagtgacctaaccctaacagctttggcaaaagatgcagcactgggtcctatccgaggtaggtatacaagagcttaaaacatttagaactatttattataccaccttagaagtttaagaa

SEQ ID NO: 10175 - DNA, 205 bp, Artificial Sequence
  Synthetic polynucleotide
atctgggctgcgcgcttgcgcttcgcttcctggccctcgtttcctgggacatccctggggctagagcactggacaatggattggcaaggacgcctaccatgcatgggctggctgcactgggagcgcttcatgtgcaaccttgactgccaggaagagccagattcctgcatcaggtatcagatattgggtactcccttccctttgc

SEQ ID NO: 10176 - DNA, 220 bp, Artificial Sequence
  Synthetic polynucleotide
gactcagaccgggactgcttggacggctcagacgaggcctcctgcccggtgctcacctgtggtcccgccagcttccagtgcaacagctccacctgcatccaacagctccacctgcatcccccagctgtgggcctgcgacaacgaccccgactgcgaagatggctcggatgagtggccgcagcgctgtaggggtctttacgtgttccaaggggacagtagc

SEQ ID NO: 10177 - DNA, 213 bp, Artificial Sequence
  Synthetic polynucleotide
ccacgcggtgggggaggcggctagcgtggtggacccgggccgcgtggccctgtggcagccgagccatggtttctaaactgagccagctgcagacggagctgcagacggagctcctggcggccctgctcgagtcagggctgagcaaagaggcactgatccaggcactgggtgagccggggccctacctcctggctggagaaggccccctggaca

SEQ ID NO: 10178 - DNA, 208 bp, Artificial Sequence
  Synthetic polynucleotide
gatgccccggtgagccccaccactctgtatgtggaggacatctcggaaccgccgttgcacgatttctactgcagcaggctactggacctggtcttcctgcttcctgctggatggctcctccaggctgtccgaggctgagtttgaagtgctgaaggcctttgtggtggacatgatggagcggctgcgcatctcccagaagtgggtccgc

SEQ ID NO: 10179 - DNA, 206 bp, Artificial Sequence
  Synthetic polynucleotide
ctcaggtggagatgcggaaagccctgacggacttcattcaagaggaattccagcatctgaagactcaggcagagcagctccacaaccacctccagcctggcctgggagataggccttgcttgctgccttctggattcttggcccgcacagagctggggctgagggatggactgatgcttttagctcaaacgtggcttttagacaga

SEQ ID NO: 10180 - DNA, 206 bp, Artificial Sequence
  Synthetic polynucleotide
gtagttgactaaacagcgtctggtggatgcagatggcatcattaatcccagcgctttctacatctacctgacggcttgggtcagcaacgaccccgtcgcgtcgcgtatgctgcctcccaggccaacatccggccacaccgaccagaatgggtccacgacaaagccgactacatgcctgaaacaaggctgagaagtaagtagcgttt

SEQ ID NO: 10181 - DNA, 206 bp, Artificial Sequence
  Synthetic polynucleotide
cttctagcagcgaggggagggcagatgtcccaggggctggtcactggagcattcctcccctctgactccccagtacaacgccctgctaagcaacatgagcttagcaggatctactccaccgccaaggtctgcctccccaacaagactgccacctgctggtccctggacccaggtacggcccttgcagctcccctctcggcggtgcc

SEQ ID NO: 10182 - DNA, 213 bp, Artificial Sequence
  Synthetic polynucleotide
aggagtgcccccgggagggcaagtctttcaaggcgaagtacaaactggtcaaccacatccgagtgcacacgggcgagaagcccttcccatgccccttcccatgccccttcccgggctgcgggaagatctttgcccgttctgagaacctcaagatccacaagaggacccacacaggtaagggaaaaaagcaggcgggcgtgggttccactggcg

SEQ ID NO: 10183 - DNA, 209 bp, Artificial Sequence
  Synthetic polynucleotide
ctcccgaggcggggactccaggggaccgcggccccagcacccaagtgcttcctttgcccccgcctgccctgcagccccaggagccgtacagcttcagcgagccgagccggcccagcaggccatgaggaaggccctcaccctgcgctacgcactcctcccccacctctacacactgttccaccaggcccacgtcgcgggggagaccgtgg

SEQ ID NO: 10184 - DNA, 220 bp, Artificial Sequence; identical to SEQ ID NO: 9924
  Synthetic polynucleotide

SEQ ID NO: 10185 - DNA, 209 bp, Artificial Sequence; identical to SEQ ID NO: 9947
  Synthetic polynucleotide

SEQ ID NO: 10186 - DNA, 208 bp, Artificial Sequence
  Synthetic polynucleotide
cccttgcagatccagaagcatcgcaagcggttgaaggcggaggagcagtggcagcgacggcagcaggtgttccgccggggcgtgtcaacgcggcgctcggcgctcggcctacgccttctcgcaccagcggggctacgcggacctcatctcctccgggcgcagcatccgcaagaagcgctcgccgcttgatgccatcgtggcggatggc

SEQ ID NO: 10187 - DNA, 221 bp, Artificial Sequence
  Synthetic polynucleotide
tgccggacgccgcgaacctgagcagcgcctggcgcaaccacactgtcccactgcggctgcgggacggccgcgaggtgccccacagctgccgccgctaccggctcgccaccggctcgccaccatcgccaacttctcggcgcttgggctggagccggggcgcgacgtggacctggggcagctggagcaggagagctgtctggatggctgggagttcagtcagg

SEQ ID NO: 10188 - DNA, 209 bp, Artificial Sequence; identical to SEQ ID NO: 10112
  Synthetic polynucleotide

SEQ ID NO: 10189 - DNA, 204 bp, Artificial Sequence
  Synthetic polynucleotide
cgcccaggatactgttacacagctctgacaaacgggcgctgctctaaccagctgccacagtccataaccaaaatgcagtgctgctgtgatgccggccgatgatgctggtctccaggggtcactgtcgcccctgagatgtgtcccatcagagcaaccggtaagagcccttccagttatctgcagaatatcccatcccagccctca

SEQ ID NO: 10190 - DNA, 209 bp, Artificial Sequence; identical to SEQ ID NO: 10070
  Synthetic polynucleotide

SEQ ID NO: 10191 - DNA, 214 bp, Artificial Sequence
  Synthetic polynucleotide
cagccgccgcccacccgacgccaggcctcgctccccgcctggcctgtccgcttcagtgttccatccgcgtctgtctccccgcaggccccggacggtgacggcggacggtgacggtgaaggtggaactgagctgcgcacccggggatctcgatgccgtcctcatcctgcagggtcccccctacgtgtcctggctcatcgacgccaaccacaacat

SEQ ID NO: 10192 - DNA, 210 bp, Artificial Sequence
  Synthetic polynucleotide
ttcttttagaaaaacaatgtggtgagtgtcaacaaggagcctgttgccgagcctgacatcatggccacaaatggcgtggtccatgtcatcaccaatgttcccaatgttctgcagcctccaggtaagtgtcgcatccccactgactctgcagccagtccttttcttcatgtggcagttggtggagagaagaaaaactgttctaaacaatga

SEQ ID NO: 10193 - DNA, 205 bp, Artificial Sequence
  Synthetic polynucleotide
ttttggcccgcttctctctctctctgtctctcggctacagacctgccacctggaactccagatgcttttgcccaactgctgacctgcccctactgcgaccgaccggggctacaagcgcttgacatcactgaaggagcacatcaagtaccgccacgagaagaatgaagagaacttttcctgccctctctgtagctacacgtttgcc

SEQ ID NO: 10194 - DNA, 215 bp, Artificial Sequence; identical to SEQ ID NO: 10059
  Synthetic polynucleotide

SEQ ID NO: 10195 - DNA, 205 bp, Artificial Sequence
  Synthetic polynucleotide
agatggctttcctgctgcagcaaccagtgctaacttatgtttggcaactggtgtacggggcggtgtggactggatgagaaagttggccttccgctacagacagacgggtaaaagagatctacaacacctacaaaaataatgttggaggcaagtgattaccaccagtacctcagcaagttaagacagtccagatacaattccaaaa

SEQ ID NO: 10196 - DNA, 215 bp, Artificial Sequence
  Synthetic polynucleotide
aaaggttctgaaggataccttgcagccacctatccaactgtcggccagaccagtccccgagccaggaaatccatgagcctggacatggggcaaccttctcggggcaaccttctcaggccaacactaagaagttgcttggttagtttatctaaattatgtagattttttttattatttaaaaaaatagatatttttactcttggaaaattatttga

SEQ ID NO: 10197 - DNA, 227 bp, Artificial Sequence; identical to SEQ ID NO: 10051
  Synthetic polynucleotide

SEQ ID NO: 10198 - DNA, 205 bp, Artificial Sequence
  Synthetic polynucleotide
ttcctatgctgaagtatttttttagagccatcttttatctttacttagaacaatgatgttgtggtttgttttattcagatcaagttttcagaagccgactgactactttggcaacgtcctacaaactcgcaagtatttagcacagtctgatttcttctggctaagaaaagccgttccaaaaacagagtgagtattaaacaaaaaa

SEQ ID NO: 10199 - DNA, 209 bp, Artificial Sequence; identical to SEQ ID NO: 10011
  Synthetic polynucleotide

SEQ ID NO: 10200 - DNA, 209 bp, Artificial Sequence
  Synthetic polynucleotide
agtgccatccgttacctggagggccaactggccctgtcgttccgcagccgtctggtggcccacgcctaccgcctctacttctcccagcagacctactaccctactaccgggtcagcaacatggacgggcggcttcgcaaccctgaccagtctctgacggaggacgtggtggcctttgcggcctctgtggcccacctctactccaacctg

SEQ ID NO: 10201 - DNA, 205 bp, Artificial Sequence
  Synthetic polynucleotide
aaaacgcggatgattctaaaacaggatttaggagaccaatgtttatttttcttttagctttgattgctaacccaaggaggaagctggtttgggccataagtaagtgtcaccatgataggtgtcgttctctttgattttgctgccgacttcattgatgggcccatcaaagcctacttatttgatgtctgctcccatcaggacaagg

SEQ ID NO: 10202 - DNA, 206 bp, Artificial Sequence
  Synthetic polynucleotide
ccctttccccatgttaaagcacagaggaccctctttcattacctcccccttccacaggcaccaaattggacagctccggtgtggcctttgctgtggttgggttggggcctgccaggccctgggtctccgggatgtccacctcgccctgtctgaggatcatgcctgggtagtgtttgggcccaatggggagcagacagctgaggtca

SEQ ID NO: 10203 - DNA, 220 bp, Artificial Sequence
  Synthetic polynucleotide
cagcagcggcggcggccgcggcagcggcggcggcggcagcggcagcggcggcagctggaggcctggctgcggctgggggccctggacaaggctgggctccctggacaaggctgggctcccggccccggccccatcacctccatcccggattcgcttgggggtcccttcgccagcgtcctatcttcgctccaaagacccaacggtgccaaagccgccttag

SEQ ID NO: 10204 - DNA, 211 bp, Artificial Sequence
  Synthetic polynucleotide
cattacttccagctgctttttgaagtgtccaccaaaatgaacgactttttcctttcttcacgcagatttcctcctagagtgccaaaatcttttccattcaattccattcaacacctcagtcgtgtacaaaaagactctgtttgtagaattcacggatcaccttttcaacatcgctaagccaaggccaccctggatgggtaatgaaaacaat

SEQ ID NO: 10205 - DNA, 214 bp, Artificial Sequence
  Synthetic polynucleotide
tgttttcaggccaaccatttaaactggatcccaaatctgctcatcgaaaactgaaggtgtcccatgataacttgacagtagaacgtgatgagtcatcatcctgagtcatcatccaagaagagtcacacacctgaacgcttcaccagccaggggagctatggagtagctggaaatgtgtttattgatagtggccggcattattgggaagtggtca

SEQ ID NO: 10206 - DNA, 207 bp, Artificial Sequence
  Synthetic polynucleotide
tcgtgttttcagggtgagcctggtctgcctggatacccagggaaccctggtatcaaaggttctgtgggagatcctggtttgcccggattaccaggaacccctgcctggagcaaaaggacaaccaggccttcctggattcccaggtaaaatttcttctcttaaatgcttccttctttccttccttatctactccaaccagtatcacag

SEQ ID NO: 10207 - DNA, 204 bp, Artificial Sequence
  Synthetic polynucleotide
atgggccagaacggcaacctctactttgccaatgtgctcacctccgacaaccactcagactacatctgccacgcccacttcccaggcaccaggaccatcatcattcagaaggaacccattgacctccgggtcaaggccagtgagtctcagaggctctgcactctctccctgactcctttcaccctcaggcatggcccttcccac

SEQ ID NO: 10208 - DNA, 211 bp, Artificial Sequence
  Synthetic polynucleotide
aggggaggaccccggctgccctgaccctcctgcccctggcttcccacagccacgccgtggcactgacccgagactctgagcggctgctggaggtgcggaagcggaagcggatcaatgtcctgcccctggggaggtgggtgaggctccagtgccccgagggcctggtgggggtggctgctgcatagccttagggattgacagagctgggaag

SEQ ID NO: 10209 - DNA, 214 bp, Artificial Sequence
  Synthetic polynucleotide
caatatccttttgaagaccataacccaccacagctagaacttatcaaacccttttgtgaagatcttgaccaatggctaagtgaagatgacaatcatgttggacaatcatgttgcagcaattcactgtaaagctggaaagggacgaactggtgtaatgatatgtgcatatttattacatcggggcaaatttttaaaggcacaagaggccctagat

SEQ ID NO: 10210 - DNA, 213 bp, Artificial Sequence
  Synthetic polynucleotide
cccgggtgcaccttcatcaacaagcccacgcggcctggctgtgagatgtgctgccgggcgcgccccgaggcctaccaggtccccgcctcataccagcccgacgagggacgaggaggagcgagcgcgcctggcgggcgaggaggaggcgctgcgtcagtaccagcaggtgggcgggaaagtccctggacagacacctgcagaccgcacggggga

SEQ ID NO: 10211 - DNA, 209 bp, Artificial Sequence
  Synthetic polynucleotide
aggagacagaacatacagagcaaaagcgaaatgtgattcgaattattcctcaccacaactacaatgcagctattaataagtacaaccatgacattgccctattgcccttctggaactggacgaacccttagtgctaaacagctacgttacacctatttgcattgctgacaaggaatacacgaacatcttcctcaaatttggatctggct

SEQ ID NO: 10212 - DNA, 215 bp, Artificial Sequence
  Synthetic polynucleotide
gactgcaacaccaacagtactctctagttcccactcacatagggggaagcccagcattttctaccagcagggcttgccagacagtcatctaactgaagaggctttgaggctttgaaagtttcagctgctcctggactagctgaccagacaactggcatgtcaactctaacctctacttcctactcacatagagagaagcctggtactttttacca

SEQ ID NO: 10213 - DNA, 220 bp, Artificial Sequence
  Synthetic polynucleotide
ggtgcctgccaggggggaggctcctaaggcccaccccggtgttttccccgccagctgccttctgccagagcctgggcgccgccgcccccgaggtccgctgccgcccccgaggtccgctgctgtgtggatgccgtgaacttcgtggccgagagcacgagagatcaggaggccaccggcgaggtgggacaggagccagaggcgggtggagcgaggcagaggc

SEQ ID NO: 10214 - DNA, 209 bp, Artificial Sequence
  Synthetic polynucleotide
gaagactcctgtacgagaagcagcagggccgggggcatcgtgaatcaggctccgggatgtgtgtgggatagagagttgggaagtgctctggacgtagtcgccatgccatggaggtaactggaatgatacgcgccgtggtggtcttggtgctgatggtagtctcggtgccggtgggtctggtggtagtggtgctgtgtgtggtggggatg

SEQ ID NO: 10215 - DNA, 204 bp, Artificial Sequence
  Synthetic polynucleotide
aacgaggtgtggacatggccaggcttggtcccgagtggagccaacccatgaagaggctgacacttggcaacaccacctcctccgtgatcctcaccaactactacatggacgtgagtgcttggctcagcccctcgctccctccctgtctcctttccctcatggacctagggctttctttgctgcaagactcaccctttccaagct

SEQ ID NO: 10216 - DNA, 208 bp, Artificial Sequence
  Synthetic polynucleotide
gtacctgggaaaattatgcttactaatgtggttttaatttcatcatgtttcatataggattcacctttatttgatcttattaaacaatcaaaggaccgaggaccgagaaggaccaactgatcaccttgaatctgcttgtcctcttaatcttcctctccagaataatcacactgcagcagatatgtaagcaaaatatatgttatgttga

SEQ ID NO: 10217 - DNA, 205 bp, Artificial Sequence
  Synthetic polynucleotide
tccatcacctggagcaatagacagtaataacagcctgtctgaaatgacacacttcaggccacagctccatcacagtggggacatggtatttacccctgagtgagtcaggcctccaattaagattaaatgagaaactggggacaactgcagcaacagagttgaagaaacttgatttcaaagtttctagtacatcaaataatctgat

SEQ ID NO: 10218 - DNA, 215 bp, Artificial Sequence; identical to SEQ ID NO: 9985
  Synthetic polynucleotide

SEQ ID NO: 10219 - DNA, 229 bp, Artificial Sequence; identical to SEQ ID NO: 9850
  Synthetic polynucleotide

SEQ ID NO: 10220 - DNA, 207 bp, Artificial Sequence
  Synthetic polynucleotide
caaggccaaccgcgagaagatgacccagatcatgtttgagaccttcaacgtgcccgccatgtacgtggccatccaggccgtgctgtccctctacgcctccgcctccggcaggaccaccggtgagtgcccgctgcccccagtcccctctcccgcccccgcccccgcccccgcccccgccgctagcgctgagagcctagcctcggcctc

SEQ ID NO: 10221 - DNA, 205 bp, Artificial Sequence
  Synthetic polynucleotide
cctgtgtctatctggagcccagcttccatctccccactgtcagatcccttgtccacctcctcttcctgcatgcagaggtcctatcccatgacctatactcactcaggcttcaggttatagtcaaggatatgctggctcaacttcctactttgggggcatggactgtggatcatatttgacccctatgcatcaccagcttcccgga

SEQ ID NO: 10222 - DNA, 213 bp, Artificial Sequence
  Synthetic polynucleotide
ttacgtgttccaaggggacagtagcccctgctcggccttcgagttccactgcctaagtggcgagtgcatccactccagctggcgctgtgatggtggccccgactgccgactgcaaggacaaatctgacgaggaaaactgcggtatgggcggggccagggtgggggcggggcgtcctatcacctgtccctgggctcccccaggtgtgggacatg

SEQ ID NO: 10223 - DNA, 219 bp, Artificial Sequence; identical to SEQ ID NO: 10169
  Synthetic polynucleotide

SEQ ID NO: 10224 - DNA, 216 bp, Artificial Sequence
  Synthetic polynucleotide
aagacgctgttcccgctgcgctccatcgacgacgtggtgcgcctgtttgctgccgagctgggccgagaggagccggacctggtgctcctttccttggtgctcctttccttggtgctgggcttcgtggagcattttctggctgtcaaccgcgtcatccctaccaacgttcccgagctcaccttccagcccagccccgcccccgacccgcctggcggc

SEQ ID NO: 10225 - DNA, 207 bp, Artificial Sequence
  Synthetic polynucleotide
ctttgagtttcacctggtgggacctcttgtccttcaggtcctggctgctgtctacaaggccctgaatgaccatcatgtttacctggagggcaccctgctaatgctaaagcccaacatggtgactgctggacatgcctgcaccaagaagtatactccagaacaagtagctatggccaccgtaacagctctccaccgtactgttcctgc

SEQ ID NO: 10226 - DNA, 210 bp, Artificial Sequence
  Synthetic polynucleotide
gcagtggaaactgcttcctgggaatactgatgatgtgccttcccttggactgtgctgcagcgcccatgccctgcagaccatgttccagttaatgactcccatgactcccaagcaaatgtacgagcacttcaaggggtacgagtatgtctcacacatcaactggaacgaggacaaagcggcagccatcctggaggcctggcagaggacata

SEQ ID NO: 10227 - DNA, 207 bp, Artificial Sequence
  Synthetic polynucleotide
tgcacacacacacacgctttttacctgagtggttaaaatgtcactctgagaggatagccctgagcagtcttcagagacgcttgtttcactctcacacccagatagatgctgcttcaccttaaataacaaaaacagaggttcagatgtaaaagcagactataaacgctgcaacttgctgtgtctttttcttctcattggcaggactgg

SEQ ID NO: 10228 - DNA, 206 bp, Artificial Sequence
  Synthetic polynucleotide
acgtaccatctttcccccaggtggtcaagtaccccctgcacgccatcatggagatcaaggagtacctgattgacatggcctccagggcaggcatgcactgcactggctgtccaccatcatccccacgcaccacatcaacgcgctcatcttcttcttcatcgtcagcaacctcaccatcgacttcttcgccttcttcatcccgctgg

SEQ ID NO: 10229 - DNA, 211 bp, Artificial Sequence
  Synthetic polynucleotide
ctggcatcgctcctcagtatacctcctgtcactgtcccttcaggactggagccgggcctcgtctttcttggcttcctcctggtggttgggatggggctggatggggctggctggggccttcctggcccattatgtgaggtgagtagtggaatgaggtaagtaggaagtgagcttgtgccagaaatggaagtctgcagcaaaaacagcaggc

SEQ ID NO: 10230 - DNA, 212 bp, Artificial Sequence
  Synthetic polynucleotide
cacgccatcggaggagccaggcgggccccagatgctgacctcccaggctccgtgtgtagatggcttcgaggagccaggagcacggcagcgggccctcagcgggccctcagcgcagtcagcgtcctcaccagcgcactggaaggtcagcaaccccaggtcatttaagcaccccccacttccgctgcaggtaccctcatctttatcccagcctg

SEQ ID NO: 10231 - DNA, 213 bp, Artificial Sequence
  Synthetic polynucleotide
actgacaagtccccttgtttgtgcccgcagaggatcagcactgccagtggagatgggcgtcactactgctaccctcatttcacctgcgctgtggacactgctgtggacactgagaacatccgccgtgtgttcaacgactgccgtgacatcattcagcgcatgcaccttcgtcagtacgagctgctctaagaagggaacccccaaatttaatta

SEQ ID NO: 10232 - DNA, 209 bp, Artificial Sequence
  Synthetic polynucleotide
tggaaatgagattactcgaggaggctccacctcttatggaaccggatcagagacggaaagccccaggaaccctagcagtgctggaagctggaactctgggactctgggagctctggacctggaagtactggaaaccgaaaccctgggagctctgggactggagggactgcaacctggaaacctgggagctctggacctggaagtactgg

SEQ ID NO: 10233 - DNA, 209 bp, Artificial Sequence
  Synthetic polynucleotide
aggccagaccagaaccagcaagactgaaaccacctgttcattacaatggcccctcaaaagcagggtatgttgactttgaaaatggccagtgggccacagatccacagatgacatcccagatgacttgaatagtatccgcgcagcaccaggtgagtttcgagccatcatggagatgccctccttctacagtcatggcttgccacggtgtt

SEQ ID NO: 10234 - DNA, 213 bp, Artificial Sequence
  Synthetic polynucleotide
ggaggtgggtacggcccagtgggggggagagggacacgccctgggctctgcccagggtgcagccggactgactgagcccctgtgccgcccccagttccgcccccagttccgccacaaagtccgctttgaagggatggagccgctgccctctcgctcctccaggggctccaaggtatccccggatgtgcccccacccagcgctggctccgatgc

SEQ ID NO: 10235 - DNA, 216 bp, Artificial Sequence
  Synthetic polynucleotide
cgctgggaggtgtatcgcaccgccagctgccagcggccggggcgcccagcgcgtgtggccctgcccggcgtggacgtgagccggcctcggctggtgctgcctcggctggtgctgccgcggctggcgctgcctgtggggcactactgctttgtgtttgtcgtgtcatttggggacacgccactgacacagagcatccaggccaatgtgacggtggcc

SEQ ID NO: 10236 - DNA, 225 bp, Artificial Sequence
  Synthetic polynucleotide
acgagcagtcgtccatggggtctgagccgttgctgctacgagtccgcggggtgtagaagtcggggctcccggtgtcgttttccgagcccaggagcttgccctgggactccagcctgggactccaggctggagctccggtgcctaaagtgcagtgcgaggctgtgcagtcgggtggggctgatgtccaccgacctgccgggagacgacccgggttggtctgggggt

SEQ ID NO: 10237 - DNA, 218 bp, Artificial Sequence; identical to SEQ ID NO: 9849
  Synthetic polynucleotide

SEQ ID NO: 10238 - DNA, 205 bp, Artificial Sequence
  Synthetic polynucleotide
attttggttccagaccaacatgatcccgggctcccccggcagtacggagttagagggtggcttcagtcggcaacgcaagcgcaagttgtccttccgcaggcaggcgcacggacaagggtgaggcgggggaggggaggaagggggagggcggggacaaggtgaggctgggagctggaaggcggggtgggccgtgtctgctttaccc

SEQ ID NO: 10239 - DNA, 221 bp, Artificial Sequence
  Synthetic polynucleotide
caggacctggaccagactccagggcgtgcccccccaccccacctgcactccctcacctgttgagctggcgctggagggcatccagcctgctctccacgtcgccccggggccgccccggggccgccgacccgggctggagagggggatgttgaggaggctgggggtgggggcggggcatcgagggagctcctggtactggcggccccgactgtccccccaga

SEQ ID NO: 10240 - DNA, 212 bp, Artificial Sequence; identical to SEQ ID NO: 10230
  Synthetic polynucleotide

SEQ ID NO: 10241 - DNA, 209 bp, Artificial Sequence
  Synthetic polynucleotide
cacgaccacgtgcctctcctctcccgcaggccgcgccaagaccttccgcctgaagctgcccgcgctgctggcgctgacggcccgggagtcgtcggtgcggtggtgcggtcgggcggcgcgggcggcgcgggcgccccgggggccgtggtggtggacgtggacctgacgcccgcggcacccagcagcgagtcgctggccctggacgaagt

SEQ ID NO: 10242 - DNA, 215 bp, Artificial Sequence
  Synthetic polynucleotide
cgactcggaacggcttccgcggccggggcagcgagggccgggggcggcgggcgggatgagtgcggtgtgcggtggagcggcgcggatgctgcggacgccgggacgccgggacgccacggctacgccgccgagttctccccgtacctgccgggccgcctggcctgcgccaccgcgcagcactacggcatcgcgggtgaggcggcgccgcgcagctg

SEQ ID NO: 10243 - DNA, 207 bp, Artificial Sequence
  Synthetic polynucleotide
ctgcccctccctgcccagcccctctcacctttgggacttggggcactttctcccagctcagcggctggggccggggcttctccaggggctccagtggcctcagtcagcaggggcaggggcaggggccagcatgggctctgccttctctggaggggatcagatgggagtcgtggtgcagccactaaccagagacccctccaccctctc

SEQ ID NO: 10244 - DNA, 204 bp, Artificial Sequence
  Synthetic polynucleotide
actgcagcaggctactggacctggtcttcctgctggatggctcctccaggctgtccgaggctgagtttgaagtgctgaaggcctttgtggtggacatgatgatggagcggctgcgcatctcccagaagtgggtccgcgtggccgtggtggagtaccacgacggctcccacgcctacatcgggctcaaggaccggaagcgaccgt

SEQ ID NO: 10245 - DNA, 215 bp, Artificial Sequence
  Synthetic polynucleotide
tgcaactgtttcttcaggcacagacagcacacattgtcctggaagatggaactaagatgaaaggttactcctttggccatccatcctctgttgctggtgaagtggttaagtggtttttaatactggcctgggagggtgagtaatgcttttccaaggctttatttttcctctagtagagaaataactggaagatctcactcatggtggtaagttga

SEQ ID NO: 10246 - DNA, 215 bp, Artificial Sequence
  Synthetic polynucleotide
tgggggcgccactgacgcctgcctggcccgccggacccttcgagaccccggtgctgcacagcctgcagagccgcgccggagccccgctcccggtgccccgctcccggtgccccggggtcccagtgcaggtaagggtcgcgcctcaggttcggggtgcgggtccaaagcgctggggcgcacgggggacgtggagcagctgctccactcgggccctg

SEQ ID NO: 10247 - DNA, 207 bp, Artificial Sequence
  Synthetic polynucleotide
caccccttcgcgcagcgcacgctcaccgcgcgcttccaggtcaacaacacccgcccgccgcacgtgcagctgttgcgcaagccggtgctcacggccatggccatggggctgctggcgctgctgggtgagccggggccgctggggtgggccggccagggccctccaggctggggagcggctcctgcgaaggccccgctgcggggagcg

SEQ ID NO: 10248 - DNA, 205 bp, Artificial Sequence
  Synthetic polynucleotide
acgtgtggtacccctgtctgctcaccatatgcttttgttttaggttctcccatggcgccagccagtgtgggcaattgcagtgtgggcaactgcagcccggacggaggcagtgtggcccaaaactgaacccctggagatggaagtaccccaggcacctatacagcccttctatagctctccagaactgtggatcagctctctccca

SEQ ID NO: 10249 - DNA, 210 bp, Artificial Sequence
  Synthetic polynucleotide
ggacactgctggctccacacaggggcccagcagggagctcgtatgccgctcgtgcctgaagcagacgctgcacaagctggaggccatgatgctcatcctgctcatcctgcaggcagagaccaccgcgggcaccgtgacgcccaccgccatcggagacagcatcctcaacatcacaggtgccgcggcccgtgccccatgccacccgcccgc

SEQ ID NO: 10250 - DNA, 213 bp, Artificial Sequence; identical to SEQ ID NO: 10234
  Synthetic polynucleotide

SEQ ID NO: 10251 - DNA, 216 bp, Artificial Sequence; identical to SEQ ID NO: 10235
  Synthetic polynucleotide

SEQ ID NO: 10252 - DNA, 206 bp, Artificial Sequence
  Synthetic polynucleotide
atttcacacgatcctttgatagtggcagtgtccgcctgcagatctcaaccccagacatcaaggataacatcgttgctcagctgaagcagctgtaccgcatcgcatccttcaaacccaggagagctggcagcccatgcagcccacccccagcatgcaactgccccctgccctgcctccccagtaattgtgaatgccatcttcttcct

SEQ ID NO: 10253 - DNA, 206 bp, Artificial Sequence
  Synthetic polynucleotide
aacgtgtgctacgatcactacttccccatctcccacatccggctatgggccctgcagctgatcttcgtgtccacgccagcgctcctagtggccatgcacgtcacgtggcctaccggagacatgagaagaagaggaagttcatcaagggggagataaagagtgaatttaaggacatcgaggagatcaaaacccagaaggtccgcatc

SEQ ID NO: 10254 - DNA, 212 bp, Artificial Sequence; identical to SEQ ID NO: 10086
  Synthetic polynucleotide

SEQ ID NO: 10255 - DNA, 219 bp, Artificial Sequence
  Synthetic polynucleotide
gagtagagtgtgggttggggggtcccaagggagggtgtgctgagctgcccccaccctgcccccaggtgctgaagggcttccctgagtgcctgcaggctgacgagtgcctgcaggctgacatctgcctgcacctgaaccgctcactgctgcagcactgcaaacccttccgaggggccaccaagggctgccttcgggccctggccatgaagttcaagacca

SEQ ID NO: 10256 - DNA, 205 bp, Artificial Sequence
  Synthetic polynucleotide
taacatttataatctgattctttttcttttgggctactcagttatgctaattaagttcctttatctgcagatatgaaaatgagcagccatttcgaaaggcaggcggcagaagaggaaattaactctctgtataaagtcattgatgaggctaatttgactaaaatggacctggagagtcaaatagaaagtctgaaagaagaacttg

SEQ ID NO: 10257 - DNA, 227 bp, Artificial Sequence
  Synthetic polynucleotide
atagaagactccttcacggctttctttttggcctcggcggcagcggctgccaccacactccccggctttcggccccgtttcttgggaatggcctgagggtcggcctcagcttttcggcctcagcttttcgcttcctgccggggcgtttgatcaccatgacctgggtggatgtggtggccccacccccctcagccttgccccctggcgaagtttgaaaaggcatcttg

SEQ ID NO: 10258 - DNA, 212 bp, Artificial Sequence
  Synthetic polynucleotide
tctctccctgttcccctgcagaaggccgggagtgtgtcaactgtggggccacagccacccctctctggcggcgggacggcaccggccactacctgtgcaatacctgtgcaatgcctgtggcctctaccacaagatgaatgggcagaaccgaccactcatcaagcccaagcgaagactggtaggagcgggcacaggtggctgggagggggctg

SEQ ID NO: 10259 - DNA, 208 bp, Artificial Sequence
  Synthetic polynucleotide
tgttctcggcctgcagagggaggctggcgggtgtgcgctgaactttgggccccgcgggagcagcacggtcaccattccacgggagcggctggcggctggcggctggcgtggagtacaccttcagcctgaccgtgtggaaggccggccgcaaggaggaggccaccaaccagacggtgggtgccgcccgcccctcggccacttgccttgg

SEQ ID NO: 10260 - DNA, 220 bp, Artificial Sequence; identical to SEQ ID NO: 9853
  Synthetic polynucleotide

SEQ ID NO: 10261 - DNA, 217 bp, Artificial Sequence
  Synthetic polynucleotide
gctggctctgcaccgcatcaggactgtgctcatgttccgggacagcaggcagtccagcaatgaggtcaaggtcatccagcaggacaacagatggctgcatccacactgtccacactgcctctgagaaagccacctctagggttttttgtatgttttcaagcctttttccttaatacagaagatatgaaatggtttcagtatcatttcagtgctggga

SEQ ID NO: 10262 - DNA, 208 bp, Artificial Sequence
  Synthetic polynucleotide
actctggaatgttctggaaatttctggaatcttctggtatagctgatgatctcgttcctgccctgactccgcttcttctgccccaggagtgaactggtgtctggtgtgagaggaccaccctgagcaatggcggctgccagtatctgtgcctccctgccccgcagatcaacccccactcgcccaagtttacctgcgcctgcccggacgg

SEQ ID NO: 10263 - DNA, 221 bp, Artificial Sequence; identical to SEQ ID NO: 10239
  Synthetic polynucleotide

SEQ ID NO: 10264 - DNA, 219 bp, Artificial Sequence
  Synthetic polynucleotide
cactgttacctaatttttaggaaattgatgtggaagtgaggaaggagattgaggatgctgcccagtttgccacggccgatcctgagccacctttggaagatgagccacctttggaagagctgggctaccacatctactccagcgacccaccttttgaagttcgtggtgccaatcagtggatcaagtttaagtcagtcagttaaggggaggagaaggaga

SEQ ID NO: 10265 - DNA, 205 bp, Artificial Sequence
  Synthetic polynucleotide
aatgtggttttaatttcatcatgtttcatataggattcacctttatttgatcttattaaacaatcaaaggaccgagaaggaccaactgatcaccttgaatgaatctgcttgtcctcttaatcttcctctccagaataatcacactgcagcagatatgtaagcaaaatatatgttatgttgaccattcaaactgcaaatagatttt

SEQ ID NO: 10266 - DNA, 210 bp, Artificial Sequence
  Synthetic polynucleotide
cgcccgccggggagcccacgcaggaggcctccggggtcgcggcggccaaagctggcatgaaccgggtattcctgcagcggctcctgtggctcctgcggctcctgcggctgctgttcccccgggtcctgtgccgggagacggggctgctggccctgcactcggccgccttggtgagccgcaccttcctgtcggtgtatgtggcccgcctgg

SEQ ID NO: 10267 - DNA, 213 bp, Artificial Sequence
  Synthetic polynucleotide
tgagcaagccgctggctctgcaccgcatcaggactgtgctcatgttccgggacagcaggcagtccagcaatgaggtcaaggtcatccagcaggacaacagatggctgatggctgcatccacactgcctctgagaaagccacctctagggttttttgtatgttttcaagcctttttccttaatacagaagatatgaaatggtttcagtatcatt

SEQ ID NO: 10268 - DNA, 208 bp, Artificial Sequence
  Synthetic polynucleotide
gaaatgttggataaagcataatttgtcaagtctcaactaattaaggtttaattcatgctttgcacaaaaattttgtgtttaggctgctgaaagccttcacccttcacaagaccattgttaagaggcgaatgtcccatgtgagtggaggaggatccatagatttgtctgacacagactccctacaggaatggatcaacatgactggctt

SEQ ID NO: 10269 - DNA, 214 bp, Artificial Sequence
  Synthetic polynucleotide
ggggacagtagcccctgctcggccttcgagttccactgcctaagtggcgagtgcatccactccagctggcgctgtgatggtggccccgactgcaaggacagactgcaaggacaaatctgacgaggaaaactgcggtatgggcggggccagggtgggggcggggcgtcctatcacctgtccctgggctcccccaggtgtgggacatgcagtgatt

SEQ ID NO: 10270 - DNA, 218 bp, Artificial Sequence
  Synthetic polynucleotide
cccaggccaggaggcccctggggggccagagatgggtaaggggaggtactggcctcaggccaaaggtgctgccgcctccgcagggaacaccagctggctgggaacaccagctggctgatgagcctggagaacccgctcagccctttctcctcggacatcaacaacatgcccctgcaggagctgtctaacgccctcatggcggctgagcgcttcaagga

SEQ ID NO: 10271 - DNA, 209 bp, Artificial Sequence
  Synthetic polynucleotide
tgggcgtgcgccgcacggacaagggcgacctgagcctacgctgcgatgagctggtgcgcacccaccacatcctcattgacctgcgccaccgccccaccgccccaccgccggcgccttcaaccactcagacctggacgccgagctgaggcggctcttccgcgagcgctatcggctgcaccccaagttcgtggcggccgtgcactacgagc

SEQ ID NO: 10272 - DNA, 205 bp, Artificial Sequence
  Synthetic polynucleotide
ttaaacaatcttttaaaatgtcattttagcttatactgcaaaaggaacttcatgtagtctatgctttatcacatgtatgtggacaagaccgaacactacttactggccagcatcctactgaggatttttcttcacgaaaagcttgaatcgttgttgttatgcacactaaatgacagagaaataagcatggaaggtatggtatggc

SEQ ID NO: 10273 - DNA, 208 bp, Artificial Sequence
  Synthetic polynucleotide
gctcatctgtttattttctgtccactacagaggcaccaagtctgaaggaggcagaagggaaagaacctgagctcttcctaagtagatccaggcctgtggcatgtggcagccaaggccaagcaggcccatctcacaaccctgaagcacatacaagcaccctggtggaagaagcttggagaagaatctggagatgagattgatgttccaa

SEQ ID NO: 10274 - DNA, 214 bp, Artificial Sequence; identical to SEQ ID NO: 10148
  Synthetic polynucleotide

SEQ ID NO: 10275 - DNA, 205 bp, Artificial Sequence
  Synthetic polynucleotide
ccttctctgcctcctccagctcagcccagcttctgtctcggtaccgacctcgggcagcagtcattgctgtcacccgctctgcccaggctgcccgccaggtcggtccacttatgccgaggagtcttccccttgctttaccgtgaacctccagaagccatctgggcagatgatgtagatcgccgggtgcaatttggcattgaaagtg

SEQ ID NO: 10276 - DNA, 210 bp, Artificial Sequence
  Synthetic polynucleotide
gagtcacccaacctttctgcacacaggcttcatcgcctcagacatgacctcccgcaactcgagcacgcagctgtggctcatcacgcactaccacgagcaccacgagcacggctccctctacgactttctgcagagacagacgctggagccccatctggctctgaggctagctgtgtccgcggcatgcggcctggcgcacctgcacgtgga

SEQ ID NO: 10277 - DNA, 207 bp, Artificial Sequence
  Synthetic polynucleotide
gaaggaggcctgtacctggctgtgaccctgttggcaggcatcactggagttgtcatcacgctgtgcctcatattaattatcacttcctccaccaaaaccaaaaccatccggaggtcttactttgaagtcttttggtacacacatcatctctttgtgatcttcttcattggccttgccatccatggagctgagtgagtgtttaaattc

SEQ ID NO: 10278 - DNA, 215 bp, Artificial Sequence
  Synthetic polynucleotide
tcggggccgccagtaccaggagctccctcgatgccccgcccccacccccagcctcctcaacatccccctctccagcccgggtcggcggccccggggcgacggccccggggcgacgtggagagcaggctggatgccctccagcgccagctcaacaggtgagggagtgcaggtggggtgggggggcacgccctggagtctggtccaggtcctggcgg

SEQ ID NO: 10279 - DNA, 206 bp, Artificial Sequence
  Synthetic polynucleotide
caagagcaagttcggcagcggctactccctgcgggccaaggtgcagagtgaagggcaacaggaggcgctggaggagttcaaggccttcgtggacctgacctgacctttccaggtgtgtgccggccccggcagcccccactgggtgggccctgggcccctacctaggcctctcccatctgctgtgcggagcgtctgtgcctcgcccc

SEQ ID NO: 10280 - DNA, 213 bp, Artificial Sequence
  Synthetic polynucleotide
aggagactattacgttcctctataaattcattaagggagcttgtcctaaaagctatggctttaatgcagcaaggcttgctaatctcccagaggaagttatagaggaagttattcaaaagggacatagaaaagcaagagaatttgagaagatgaatcagtcactacgattatttcggtaactaactaactataatggaattataactaactgac

SEQ ID NO: 10281 - DNA, 206 bp, Artificial Sequence
  Synthetic polynucleotide
atccaaagtgcagagtctccacttgtggaacaatggtaggaatcatttaatttttaatttatattccggcacttggcctgactacaccgaggacgtggggtggggtttgacatcggccaggcgatgctggccaaagccagcatcagtactgaaaacttccgacccaactttgatgtttctattcccctcttttctaaggatcatcc

SEQ ID NO: 10282 - DNA, 208 bp, Artificial Sequence
  Synthetic polynucleotide
ctcttcccgattgcagatgtggatccagctgttgtacagtgcctgcttctggtggctgttttgctatgcagtggatgcttatctggtgatccggagatcggagatcggcaggactgaggtattcaccgaggaaatgggatttctgccctagttctattttagagggaagataagagatggcactgagcgtttaaaagtattttgcagt

SEQ ID NO: 10283 - DNA, 212 bp, Artificial Sequence
  Synthetic polynucleotide
gtgaactcgtacaatggcctgggaggcccgccggccgcacccccgcctccgccgcacccccacccgcatccgcacgcacaccatctgcacgcggccgccgcgcggccgccgcaccgccgcctgccccaccgcaccacggggccgccgcgccgccgccgggccagctcagccctgccagcccagccaccgccgcgcccccggcgcccgcgccc

SEQ ID NO: 10284 - DNA, 205 bp, Artificial Sequence
  Synthetic polynucleotide
cctgctttgtagacatctcatcccaaagcttgaaattgtctttttttttctttcccaaaagtaccagaataggagttttcctctgtggacctgaagccttccttggctgaaaccctgagtaaacaaagcatctccaactctgagtctggccctcggggagtgcatttcattttcaacaaggaaaacttctaacttgtctcttcca

SEQ ID NO: 10285 - DNA, 209 bp, Artificial Sequence
  Synthetic polynucleotide
ggatgtcctcatgctccctggtgacctcgttggcttgcagcacgacgctggccctggcgccctcctgcactgctcgccggctcccggccaccctggtcccctggtccccgggccccgtacctctccgccaacgcctcgtcatggctgccccacttgccagcccagctggagggcacttgggcctgccctgcctgtgccctgcggctgct

SEQ ID NO: 10286 - DNA, 206 bp, Artificial Sequence
  Synthetic polynucleotide
tagtgacagccgcttcttgctgggcagctggctagagcaggcccgagcagcggcagtcagtgaggccgaggccgatttctacgagcagaacagccgctacgctaccagctgaccttgtgggggccagaaggcaacatcctggactatgccaacaagcagctggcggggttggtggccaactactacacccctcgctggcggctttt

SEQ ID NO: 10287 - DNA, 208 bp, Artificial Sequence; identical to SEQ ID NO: 10125
  Synthetic polynucleotide

SEQ ID NO: 10288 - DNA, 211 bp, Artificial Sequence
  Synthetic polynucleotide
agttcacccatgcagggcagggagggctgattgaagagcccacaggtgatgagctaccaaccaagaaggggcggaggaaccgtttcaagtggggcccagcggggcccagcatcccagcagatcctgttccaggcctatgagaggcagaagaaccctagcaaggaggagcgagagacgctagtggaggagtgcaataggtacaacggcgggc

SEQ ID NO: 10289 - DNA, 208 bp, Artificial Sequence
  Synthetic polynucleotide
gcacagcctcaaccccgacgcctcgggctccagctgcagcctggcccggacgcgctcccgagaaagctgcgccagcgtgcgccgcgcctcgtcggccgacggccgacgacatcgaggccatgcgcgccggggtgctgcccccgccaccgcgccacgccagcaccggtgagggcgccgcgggacccgttccgccccagcccacgcttct

SEQ ID NO: 10290 - DNA, 206 bp, Artificial Sequence
  Synthetic polynucleotide
ccctgtggctgtcaggcctgagggtcgggtggggcgtggggaaagtccctgactcggctggatctccctgtggcagggttgcttcacccacaccgtcatgtcatgtactacggccactacagtaacgccacgctgaaccagccgtgtggcagccccctggatggcagccagtgcacacccagggtgggtggcctgccctacaacat

SEQ ID NO: 10291 - DNA, 206 bp, Artificial Sequence; identical to SEQ ID NO: 10161
  Synthetic polynucleotide

SEQ ID NO: 10292 - DNA, 219 bp, Artificial Sequence
  Synthetic polynucleotide
tctccttcacttactgctgtggactctccttaggggaatgtcgggtgcttcttcctcaagcagctcagcactttgtaggagagcatggatctctgggtgcagatcctcccagatcctccatactagcttcccctgaggccagtgctctgcagtgcaataccaaggcgacatctggattataaaaatgaaaataccggcatactctacttgcttcatgca

SEQ ID NO: 10293 - DNA, 208 bp, Artificial Sequence
  Synthetic polynucleotide
tgggatgatctacagcttgcctggcctgaaaatgtatgagcaagagtgggtgaggttacacctgctgaacataggcggctcccaagacattcacgtggttcgtggttcactttcacggccagaccttgctggaaaatggcaataaacagcaccagttaggggtctggccccttctgcctggtaaagattgggtaatgggaagaggtcc

SEQ ID NO: 10294 - DNA, 211 bp, Artificial Sequence
  Synthetic polynucleotide
gcctcttgactcctactgtcctccctcctcccacaggatgtcctctagggttttatggaaaagattgtgcactgatatgccaatgtcaaaacggagctgaacggagctgactgcgaccacatttctgggcagtgtacttgccgcactggattcatgggacggcactgtgagcagagtaagtatgagagtgtggcatcactgggtggtattt

SEQ ID NO: 10295 - DNA, 207 bp, Artificial Sequence
  Synthetic polynucleotide
ccaccattcagggagcctgggaggtgcctttcgcacccagacccccgtgggctctctcctgatggctcctgcccttttcccttccctcctcagcccccagccccagtgcctggtgctcacggggccccccaacttccgcccggccctggtggactttgtgggcaccttcacccggaacctcagcctgatgatctgtggccacgtgct

SEQ ID NO: 10296 - DNA, 207 bp, Artificial Sequence
  Synthetic polynucleotide
ccaccacggcatccggccctgcgtcatctcgcgccagctgcgcgtgtcccacggctgcgtctccaagatcctgtgcaggtaccaggagactggctccatacccatacgtcctggtgccatcggcggcagcaagcccaaggtgagcgggcgggccttgccctcctggctcccagactgtggtcccctgtgttggggaagaccgggcgg

SEQ ID NO: 10297 - DNA, 205 bp, Artificial Sequence
  Synthetic polynucleotide
ttctccctccccacccttggtgcagaggaggctggcagctgtgtgcaggatgggcagaggtataatgataaggatgtgtggaagccggagccctgccggatggatctgtgtctgtgacactgggactgtcctctgcgacgacataatctgtgaagacgtgaaagactgcctcagccctgagatccccttcggagagtgctgcccc

SEQ ID NO: 10298 - DNA, 205 bp, Artificial Sequence
  Synthetic polynucleotide
agctaagagggaagcctggctgcagttgagggccgaaattgaagccctgaccgactcctggttgacactggccctgaaagcactctcgctcattcactccctcccggtgaggctctctgcggggtctttgccaggaaatgggcaatgctcgtgcttgttcattttggagatttatttttcaacagtctttgttttctttttgttc

SEQ ID NO: 10299 - DNA, 211 bp, Artificial Sequence
  Synthetic polynucleotide
gtaggcacgtgctagggggggccctggggcgccccctcccgggcactccctgagggctgcacggcaccgccacaggcactgcacccgttcgcggcggacggcggcggacgacacctgccggaccagccagggctccccggctttccagccgcccgagattgccaacggcctggacaccttctccggcttcaaggtggacatctggtcggct

SEQ ID NO: 10300 - DNA, 206 bp, Artificial Sequence
  Synthetic polynucleotide
ggcccctgctggctcgtggcgcggggcggctgcggagggccccgcgcctggtcccagtgcggcggcggagggctccgagcctggtcccagcgcagcgcagcgcagccggacgcgtctgccggccccctggcccggctggcacggagcagagccgcgggctggggcacggctcgacgtcgagaggcggcccctgggtggggacaggg

SEQ ID NO: 10301 - DNA, 207 bp, Artificial Sequence
  Synthetic polynucleotide
cggaaaaatctattatagccccagcattctccaacttcaaagtcagatgcaaattctcgaatgatattttttgtaggatcattacaggactggtgaaccatctatctctacacgatattcatatctaaaattgaaaaacagaccattactatacagttagtaaagtaagaataaaaaacaaactcatctaaacattaaggtcactaa

SEQ ID NO: 10302 - DNA, 225 bp, Artificial Sequence; identical to SEQ ID NO: 10172
  Synthetic polynucleotide

SEQ ID NO: 10303 - DNA, 205 bp, Artificial Sequence
  Synthetic polynucleotide
ctgggaagatgagatgaggatcccatgccctaatcgccaattctgacccattcctcgatgtctatagacctgatcgtgggagcttacggggccaaccaggtaggtggctgtgtacaggtgagcactggctccaggggcgggatggggaaggtcctgtgccatcaagaggaggccaggccaggaggagccacaatggcaagcctac

SEQ ID NO: 10304 - DNA, 210 bp, Artificial Sequence
  Synthetic polynucleotide
acttggggatggtggaggagtggggaggggtatcttgggcctagctaagttgtgtttttctttttcatttcacagggtccttctggtcctgttggtcctgttggtcctgctggtgctgttggcccaagaggtcctagtgtatgtacatgctgaagatttctttgcaacactaacatttagagagaatcagtccaaaacatctgttaagaa

SEQ ID NO: 10305 - DNA, 208 bp, Artificial Sequence
  Synthetic polynucleotide
gcaagagctccctgttccggatcctgggtgggctctggcccacgtacggtggtgtgctctacaagcccccaccccagcgcatgttctacatcccgcagagcgcagaggtaaggaagcccgtgcgcctctcctccacctcttcctgcctgtgcgctcacacatggcttcctgcagaggcccaggaagtggtgaagagtcagcacctcag

SEQ ID NO: 10306 - DNA, 214 bp, Artificial Sequence
  Synthetic polynucleotide
gcgcagcggccgctgccgccgccgccgccgccgccgccgccgctgggggcctggcgctggggctgcaccctgggggcgcgcagggcggcgcgggcctcccgcgcgggcctcccggcgcaggcggcgctctacggccacccggtctacggctactccgcggcggcggcggcggctgcgctggcgggccagcacccggcgctctcctactcgtacc

SEQ ID NO: 10307 - DNA, 205 bp, Artificial Sequence
  Synthetic polynucleotide
cagggctgctgagggaagggactgaggtgcgcgtgtctctgcagcccaggggtcactgtccttctgcatgctggaagccagccaggacatgggccgcacgcacgctcgagtggcggccgcgtactccagccttggtccggggctgccacttggaaggcgtggccggccacaaggaggcgcacatcctgagggtcctgccgggcca

SEQ ID NO: 10308 - DNA, 210 bp, Artificial Sequence
  Synthetic polynucleotide
cggagaccgacgaggacgagggcgcgggcgcggcggaggcgggcgcggaaggcgcggaggagggcgcggcggggctcgagggcacggcggccacggcggccacggcggcggcgggggcgacggcgcgggttgtggcggccgcaggccgggccctgcgaggcctcagctaccgcagcctgcggcggcgcgtgcggcggctgcggcggctta

SEQ ID NO: 10309 - DNA, 220 bp, Artificial Sequence
  Synthetic polynucleotide
agccaccaggcgtggctctgcccacggtctcaccacctggtgtggatgccaaagcccaggtgaagacagagaccgcggggccccaggggcccccacactacgctggggcccccacactacaccgaccagccatccacctcacagatcgcctacacctccctcagcctgccccactatggctcagccttcccctccatctcccgcccccagtttgactact

SEQ ID NO: 10310 - DNA, 206 bp, Artificial Sequence
  Synthetic polynucleotide
cgagcccttggggcgcactcgctcagctgtcttcggttctctctgcaggtgagcagcagtactcggtgccgcccccggtctatggctgccacacccccaccccaccgacagctgcaccggcagccaggctttgctgctgaggacgccctacagcaggtaggaaggcgctgggctctgcgtctgggtccttgggaccccggagggga

SEQ ID NO: 10311 - DNA, 205 bp, Artificial Sequence
  Synthetic polynucleotide
gccaaaggcaaagtggccaacactaatgtgaccttgcaggcactacggggcaccaaggtggcggtgaatcagcggagcgcggatgcactccctgcccccgtccgtgcctggtgccaacagcatcccgtgggtcctcgagcagatcttgtgtctgcagcagcagcagctacagcagatccagctcaccgagcagatccgcatccag

SEQ ID NO: 10312 - DNA, 212 bp, Artificial Sequence
  Synthetic polynucleotide
aggcggaggccccctcttccccaggcctgcgtagatatccctcagctgctggaggaggcggtgggggcgggggctccgggcagtgctggcggcgtcctggcggcgtcctggctgccctgctggaccatgtcaggagcgggtcttgcttccacgccttgccgagccctcagtacttcgtggactttgtgttccagcagcacagcagcgaggtc

SEQ ID NO: 10313 - DNA, 205 bp, Artificial Sequence
  Synthetic polynucleotide
tacagcctaggcagcatctacactcgcctgtatgggcagtcccctccagactcgcacacggctgagggtgatgtcctggccctgctcagcatctgtcagtcagtggagaccacaggccctgctgcggtgggtggatgctcacgccaggcctttcggcaccatcaggcccatgtatggggtcacagcctctgctaggaccaagcca

SEQ ID NO: 10314 - DNA, 215 bp, Artificial Sequence; identical to SEQ ID NO: 10278
  Synthetic polynucleotide

SEQ ID NO: 10315 - DNA, 207 bp, Artificial Sequence
  Synthetic polynucleotide
ctggagccaccaccagagcttctggcactggaaatggagctgccagaactgctggagccactgtagctactgaaaccgctggagtcacccttcccagtgaggcaggcaggggtcgttaggggaggtgatacgcgtggggtccttacaagggtctgagaaggtgccaatgctcttagccaaggtccctgtggaggaaagcagtggtta

SEQ ID NO: 10316 - DNA, 207 bp, Artificial Sequence
  Synthetic polynucleotide
cactggggagaggctccccgcagcccactctgactgtgccctctgccctgcaggagagtatgacctgcggcgctgggagaagtgggagctggacctggacctggacatcaaggaggtcttcgtccaccccaactacagcaagagcaccaccgacaatgacatcgcactgctgcacctggcccagcccgccaccctctcgcagaccat

SEQ ID NO: 10317 - DNA, 205 bp, Artificial Sequence
  Synthetic polynucleotide
atctgcttatgaccaggagccactcaagcagcactctcccttcacaggtggtattccaaacacatgactcggagtcaggctgagcaactgctaaagcaagaaagaggtaagtgtggaaccactagcacacagcattctccttgcataagtgaggatcttgaactgagggcctgttctgccccctacctttgggcaaggcagtgtc

SEQ ID NO: 10318 - DNA, 206 bp, Artificial Sequence
  Synthetic polynucleotide
gccggacaggcagccccggtgagggagcccacgtgtcagcagctgtggccaagactgtgaggatgacgctagtgattgtggtcgtctatgtgctgtgctgtgctgggcacccttcttcctggtgcagctgtgggccgcgtgggacccggaggcacctctggaaggtgggtgtagccgtggctagggctgacggggccacttgggct

SEQ ID NO: 10319 - DNA, 218 bp, Artificial Sequence; identical to SEQ ID NO: 9878
  Synthetic polynucleotide

SEQ ID NO: 10320 - DNA, 205 bp, Artificial Sequence
  Synthetic polynucleotide
ggagctgggaccacagtggctgagcttccggtgtgtcttccaggagaccctgtgaagccgtctcggggcccgctggtgacctgcacgtgtgagagcccacccacattgcaaggggcctacctgccggggggcctggtgcacagtagtgctggtgcgggaggaggggaggcacccccaggaacatcggggctgcgggaacttgcac

SEQ ID NO: 10321 - DNA, 212 bp, Artificial Sequence; identical to SEQ ID NO: 9951
  Synthetic polynucleotide

SEQ ID NO: 10322 - DNA, 218 bp, Artificial Sequence
  Synthetic polynucleotide
attcttacggcctgatgttcgacctgcctctccccagagtcctgcctctgccccctggagatgaatgtggcccaggaattccagctccgacgacggcagctctccgacgacggcagctggggagccaaggaagttcctggagcaagtggagcagccccgtgtgcgttccccctggtaagatcactctgagtacaggaacaggggcaagcattagaaat

SEQ ID NO: 10323 - DNA, 207 bp, Artificial Sequence
  Synthetic polynucleotide
agaggctctgagaagaagaccagcggccccctttctcctcccacagggcctcctggcccggcgcctgcaggccccgccgtgcggctggggtccgtgccctacttactccctgctcttccgcgtcctgctgcagtgcttgaagcaggtgagtggggccgggcagggaccatccgtcccacgttgggccaggaggacagggagctgcca

SEQ ID NO: 10324 - DNA, 207 bp, Artificial Sequence
  Synthetic polynucleotide
tgtctattttgcttcttttagatgtaacatgtaacattaagaatggcagatgcgagcagttttgtaaaaatagtgctgataacaaggtggtttgctcctgctcctgtactgagggatatcgacttgcagaaaaccagaagtcctgtgaaccagcaggtcataatctgaataagattttttaaagaaaatctgtatctgaaacttcag

SEQ ID NO: 10325 - DNA, 205 bp, Artificial Sequence
  Synthetic polynucleotide
gctgccctctcgctcctccaggggctccaaggtatccccggatgtgcccccacccagcgctggctccgatgcctcgcacccctccacctcctccagccagccagctggatgggctgagcgtgagcctgggccggctggggacaaggtgtgagcctgagccctcccgcctccaagccgtgttcgaggccctgctcacccagtttga

SEQ ID NO: 10326 - DNA, 209 bp, Artificial Sequence
  Synthetic polynucleotide
ggtaagcagtggccccgaacctacccccaaacccgggctcgctcccgggaggcggggcccgctctcactggctctccctccagccggcggccagaaatgcagaaatgcacggtctccatcaacgtcctgctcgcccagaccgtcttcttgttcctcattgcccagaaaatcccagagacttctctgagcgtgccgctcctgggcaggtg

SEQ ID NO: 10327 - DNA, 210 bp, Artificial Sequence
  Synthetic polynucleotide
ggaccccatgttactgaagtggaagggaccagtttcttaactggaattattagctggggtgaagagtgtgcaatgaaaggcaaatatggaatatataccatatataccaaggtatcccggtatgtcaactggattaaggaaaaaacaaagctcacttaatgaaagatggatttccaaggttaattcattggaattgaaaattaacagggc

SEQ ID NO: 10328 - DNA, 215 bp, Artificial Sequence; identical to SEQ ID NO: 10013
  Synthetic polynucleotide

SEQ ID NO: 10329 - DNA, 205 bp, Artificial Sequence
  Synthetic polynucleotide
aatcagatttggacaccctggctaaagaagcatccatcccaattatcaatgggctgtcagatttgtaccatcctatccagatcctggctgattacctcactcacgctccaggttggtttatttatttgtcttacaaaagagcaaaatcaaataattcctgacttgctttaagtgaaacagtttacttaaatcatggtattggtgt

SEQ ID NO: 10330 - DNA, 205 bp, Artificial Sequence
  Synthetic polynucleotide
ttttcatttcctcattggaagaagaagcatagtatagaagaaaggcaaacacaacacattcaacctctgccaccatggggaactgggctgtgaatgagggaggggctctccatttttgtcattgtaagtaccaacaagagataagttataaattctctgacttctcggggttatcttggaactaaaatagaccaaagcttttttg

SEQ ID NO: 10331 - DNA, 219 bp, Artificial Sequence
  Synthetic polynucleotide
cgcagagctccaagagggcgcgcgccagaagctgcacgagctgcaagagaagctgagcccactgggcgaggagatgcgcgaccgcgcgcgcgcccatgtgggcgcgcgcgcccatgtggacgcgctgcgcacgcatctggccccctacagcgacgagctgcgccagcgcttggccgcgcgccttgaggctctcaaggagaacggcggcgccagactggc

SEQ ID NO: 10332 - DNA, 217 bp, Artificial Sequence
  Synthetic polynucleotide
tagaaaggctggggtgttgggctcatggattgggtcatgtgggcccattttaccttttgaagtattgctcccccagtggattgggtggctccattcactccaatgctgccaatgctgagcacttccacagagtgggttaaagcggctccgaacacgaaacgtgtagcgtttctgcccatccacactaggcaaggagaacttatgtctataatccact

SEQ ID NO: 10333 - DNA, 208 bp, Artificial Sequence
  Synthetic polynucleotide
gtgtttgtgacactcttgtgaccgtgccaagaaaacgtaagcaaatatcaagcctccaaatcctaatgcaacaagtcctgaatcccttgcaggtatgtcctatgtcctggatgatgaatacacaagctcagtaggctccaaatttccagtccggtggtccccaccggaagtcctgatgtatagcaagttcagcagcaaatctgacatt

SEQ ID NO: 10334 - DNA, 210 bp, Artificial Sequence
  Synthetic polynucleotide
ggaactcttacacgtgtaggagccaaacatgagagacacatatttctctttgatggcttaatgatttgctgtaaatcaaatcatgggcagccaagacttccaagacttcctggtgctagcaatgcagaatatcgtcttaaagaaaagttttttatgcgaaaggtacaaattaatgataaagatgacaccaatgaatacaagcatgctttt

SEQ ID NO: 10335 - DNA, 205 bp, Artificial Sequence
  Synthetic polynucleotide
tcaagcacttagcaagcccctggcacttgataaagcttagtaaatatagctaattgtggtgacactcttcttcaatttatcaaggcaccaaaaacccctccctctgcagaagagcatggacctcttaggaaaacaactttccttttactcctttggtataataggtaagagaagagtgagtatgtatatatttttatttgagttt

SEQ ID NO: 10336 - DNA, 213 bp, Artificial Sequence
  Synthetic polynucleotide
caataccgccaggtggccagcccgcggaccgacccctactcggcggcgcaactccacaaccagtacggccccatgaatatgaacatgggtatgaacatgggtatgaacatggcagcagccgcggcccaccaccaccaccaccaccaccaccaccccggtgcctttttccgctatatgcggcagcagtgcatcaagcaggagctaatctgcaag

SEQ ID NO: 10337 - DNA, 206 bp, Artificial Sequence
  Synthetic polynucleotide
gcaaaatagcccagtataagcgggagtgcccgtccatctttgcttgggaaatccgagacagattactgtccgagggggtctgtaccaacgataacataccataccaagcgtaagttcattgagaacatctgccctccctgccctaagcccaatgctctctcctctttacctcctcccaccctctctctccactgtctcttagtctg

SEQ ID NO: 10338 - DNA, 212 bp, Artificial Sequence
  Synthetic polynucleotide
gtagctgttgtttttaactttttattccaaaatacggctgttccaaaaaatcttgaccttgatattttttcttctagtccttcttggaatggccttggaatggccttggaagcatccctagcacagatatctacaaaagtaccaagaattacaaaaacgtaagtacctttgtgagacatttgctggacttgggtttactagcctgaagtttc

SEQ ID NO: 10339 - DNA, 207 bp, Artificial Sequence; identical to SEQ ID NO: 10315
  Synthetic polynucleotide

SEQ ID NO: 10340 - DNA, 207 bp, Artificial Sequence
  Synthetic polynucleotide
ccttcactactctgctaccagataaataacaggagatttaacaatcatcacatggaaaaccattccctgaataacacagccttctctgtctctcttggcagtcagtcggtcttggcagctgttgtaattgccaacctgaaagggatgtttatgcagctgtgtgacattcctcgtctgtggagacagaataagattgatgctgtaagt

SEQ ID NO: 10341 - DNA, 210 bp, Artificial Sequence; identical to SEQ ID NO: 10152
  Synthetic polynucleotide

SEQ ID NO: 10342 - DNA, 209 bp, Artificial Sequence
  Synthetic polynucleotide
aacaccgagctcaggttggaatgatctaaggacacaaaagcatggggcctcggggctggggcggtgcgactaccggaggcgcaagttgcgcacggggtcccgggccgggagcgatacactgcctccccggtgtcagtgctccagacggtctccgccatgacagctgcgacgcgccgcgactgcgccggaaagcgcgccgctctgttttc

SEQ ID NO: 10343 - DNA, 214 bp, Artificial Sequence; identical to SEQ ID NO: 10148
  Synthetic polynucleotide

SEQ ID NO: 10344 - DNA, 205 bp, Artificial Sequence
  Synthetic polynucleotide
cagtcctgtcatccagctgcagcccaccttcacacccatgcgggtcgcactggctggcacattccactactacagctgcgagagagccaaaaaggccatgcatgggctaccagccactagtgaccatggatgatgctatggagaggaccgtgcagagctttcgccacctgcggagggtcaagtgagggacactggaggctgggct

SEQ ID NO: 10345 - DNA, 225 bp, Artificial Sequence; identical to SEQ ID NO: 10236
  Synthetic polynucleotide

SEQ ID NO: 10346 - DNA, 205 bp, Artificial Sequence
  Synthetic polynucleotide
atgtggaggatgaggtgggaggagggacggcagccctgcttctcttctgcccagcttcaaggagcggttccatgccagcgtgcgcaggctgacgcccagctagctgcgagatcaccttcatcgagtcggaggagggcagtggccggggcgcggccctggtctcggcggtggcctgtaagaaggcctgtatgctgggccagtgaga

SEQ ID NO: 10347 - DNA, 210 bp, Artificial Sequence; identical to SEQ ID NO: 10143
  Synthetic polynucleotide

SEQ ID NO: 10348 - DNA, 208 bp, Artificial Sequence
  Synthetic polynucleotide
aagtgccgttaggccaagcaggtgctaaaagcccggggtcgtggaccccggccaggtcttagcagcatggaggcgcagggtgtagcggagggcgcggggcgcggggccgggcgccgccagcggcgtgccccaccccgcggccctagccccggctgcggctcccaccttggcgccagcctcggtggcggccgcggcctctcaattcacc

SEQ ID NO: 10349 - DNA, 209 bp, Artificial Sequence
  Synthetic polynucleotide
gtgttcattgcaggaagagtaaataaaggtggtattttgattagaagtgccagaggaattttcttctggatttttgcaaatggatcttacagggttacagggttacaggtgatttaggtaactgactttttttttttttaatagcatatgacttatgggctatgttactttgagcacctacttgttatttgtgggagtgataaaaagaa

SEQ ID NO: 10350 - DNA, 213 bp, Artificial Sequence; identical to SEQ ID NO: 10015
  Synthetic polynucleotide

SEQ ID NO: 10351 - DNA, 207 bp, Artificial Sequence
  Synthetic polynucleotide
atcagcgctctagtcacgattgccaccaagaccttcctccgttatgatcggctacgggctctcatcaccagtatccgccgcttctacccaacggttaccgttaccgtggtcatcgctgacgacagcgacaagccagagcgcgttagtggcccctacgtggaacactatctcatgcccttcggcaaggtgtgcagctagcaggctgaa

SEQ ID NO: 10352 - DNA, 205 bp, Artificial Sequence
  Synthetic polynucleotide
aaaaacagttatgaaaactggatctgcaggcctttcaggccaccatagagcacctagttacagtggtttatccatggtttctggagtgaaacagggatctatctggtcctgctcctaccactcataaggtattctgggacagtaactttaattgctgtctttttgcaaatagaaaaatttttaagatactattcctgcttaagtt

SEQ ID NO: 10353 - DNA, 206 bp, Artificial Sequence
  Synthetic polynucleotide
ggcctggccgccctcggcgtccgcggcgctcaacagcggcgcctcttatatcaagcagcagcccctgtccccctgtaaccccgcggccaaccccctgtcctgtccggcagcctctccacgcactccctggagcagccgtatctgcaccagaacagccacaacgccccagccgagctgcaaggtgagtggggaggccgagggcgccc

SEQ ID NO: 10354 - DNA, 205 bp, Artificial Sequence
  Synthetic polynucleotide
ttatcgtcgtctgtcttttcctgggcctttgcgatggcttcttcatcaccatcatggcccccattgcatttgagctggtgggcccaatgcaggcctcacacacaggccattggctacctcctgggcatgatggccctgccaatgattgctgggccccccattgcaggtgaggctgatattccagggagggcatgaatcagggagt

SEQ ID NO: 10355 - DNA, 205 bp, Artificial Sequence
  Synthetic polynucleotide
aggaaacacaagaccaatcggaagccgcgcacgccctttaccacatcccagctcctcgccctggagcgcaagttccgtcagaaacagtacctctccattgattgcagagcgtgcagagttctccagctctctgaacctcacagagacccaggtcaaaatctggttccagaaccgaagggccaaggcgaaaagactgcaggaggca

SEQ ID NO: 10356 - DNA, 220 bp, Artificial Sequence; identical to SEQ ID NO: 10068
  Synthetic polynucleotide

SEQ ID NO: 10357 - DNA, 207 bp, Artificial Sequence
  Synthetic polynucleotide
acctatcggccgtgctgggtctcagcgaggagagtctgcagtgccggcgcaggcagcgcggggacgcggggtccccttggggctgcccgctgtgccccgaccgaccgtggccccgcagaggcgcagacgcaggcggaggggcaggggcaagggcaggggcaggggcaggggcaagggcaggggcaaggacaggggcaaggacagggg

SEQ ID NO: 10358 - DNA, 207 bp, Artificial Sequence
  Synthetic polynucleotide
gagagaaggaggccaagagaaaccgcaccttcgtcctcaacttcatcaagattcccgtggtcccgcacaatgagtgcagcgaggtcatgagcaacatggtcatggtgtctgagaacatgctgtgtgcgggcatcctcggggaccggcaggatgcctgcgagggcgacagtggggggcccatggtcgcctccttccacggcacctggt

SEQ ID NO: 10359 - DNA, 212 bp, Artificial Sequence; identical to SEQ ID NO: 10140
  Synthetic polynucleotide

SEQ ID NO: 10360 - DNA, 205 bp, Artificial Sequence
  Synthetic polynucleotide
tgccacgatgggaagtgcatctctcggcagttcgtctgtgactcagaccgggactgcttggacggctcagacgaggcctcctgcccggtgctcacctgtgtgtggtcccgccagcttccagtgcaacagctccacctgcatcccccagctgtgggcctgcgacaacgaccccgactgcgaagatggctcggatgagtggccgcag

SEQ ID NO: 10361 - DNA, 212 bp, Artificial Sequence
  Synthetic polynucleotide
gaaatacctaacactgctttggtgaaattttgtaaacctcttatccttagatccaaaagatatgttcatctaggcttgataagcacatgtgcatttataccgcatttataccacactctatagttctttgtggaccagtgcatggtctcattgaacaacatgaggatgctttacatggagcacttaaaatgcttcggcaattatttaaagac

SEQ ID NO: 10362 - DNA, 205 bp, Artificial Sequence
  Synthetic polynucleotide
aagaacgaggaactgcgtctttatcaccatctcttcaacaactatgacccaggaagccggccagtgcgggagcctgaggatactgtcaccatcagcctcaatcaaggtcaccctgacgaatctcatctcactggtaagctacccccaccctcatcttaagccaaaaatcccacttctggccccaaccgctgagctctgtcctaaa

SEQ ID NO: 10363 - DNA, 213 bp, Artificial Sequence; identical to SEQ ID NO: 10222
  Synthetic polynucleotide

SEQ ID NO: 10364 - DNA, 208 bp, Artificial Sequence
  Synthetic polynucleotide
cccaccccctggccgtcgcgggacccgcaggactgagaccatggaggcggtggcggtggccgcggcggtgggggtccttctcctggccggggccgggggccgggggcgcggcaggcgacgaggcccgggaggcggcggccgtgcgggcgctcgtggcccggctgctggggccaggccccgcggccgacttctccgtgtcggtggagcg

SEQ ID NO: 10365 - DNA, 211 bp, Artificial Sequence
  Synthetic polynucleotide
accaatgtcatgcctcaagatcttgatgatgtttgtcagagcaggcaggctacgtttatccaaatgggtgaaaaattcatactcatctttctttaaacgagaaggagaaggtctagattcaatgtgggtcaggtttacatcattctcctagaagagagaatggggagggtgaggagacagtcactggaactaacgcaggccaaagatgcag

SEQ ID NO: 10366 - DNA, 218 bp, Artificial Sequence
  Synthetic polynucleotide
atgttcaggagaccccactcatgtttagcagatgtacttctgtcagttcacttgatagttttgagagtcgttcgattgccagctccgttcagagtgaacctccgttcagagtgaaccatgcagtggaatggtaagtggcattataagccccagtgatcttccagatagccctggacaaaccatgccaccaagcagaagtaaaacacctccaccacctc

SEQ ID NO: 10367 - DNA, 208 bp, Artificial Sequence
  Synthetic polynucleotide
cccccgtgccccacagatcgcaagcaggactggtcagaccatgctatttggtgggaacagaagaggcagtggctgctgcagacccactggacactggacactggacaagtacgggatcctggccgacgcacgcctcttctttgggccccagcaccggcccgtcatccttcggttgcccaaccgccgcgcactgcgcctccgtgccagc

SEQ ID NO: 10368 - DNA, 211 bp, Artificial Sequence
  Synthetic polynucleotide
tccctttcctctccttgagactaatgcccccacccccacccccaccccacctaccggacagatgaacagtttctgctgcagcggctggcagacggggccagacggggccatcgacctctatgccatggtggtggttctctcgaggtgaggaggcaggcagggaatgcctgagccgcagggggcctgggcctggatcccagccggcccagat

SEQ ID NO: 10369 - DNA, 205 bp, Artificial Sequence
  Synthetic polynucleotide
gccgcctcccaaaggtgccacatactgctctctctttctcctccaggaagtccataggactgtcttcatgcgcttgaacatcatcagccctgacctgtctgtctggtgagctccctccaggtctctcgggtttgttctagtggctgaggtcacagtagggcacagcgggcagccctgagaaacggcctgggcacatagcacatgg

SEQ ID NO: 10370 - DNA, 212 bp, Artificial Sequence
  Synthetic polynucleotide
tgtagagaggagggcgtgtgcaaggagtggggccaggagcggggctggacactgctggctccacacaggggcccagcagggagctcgtatgccgctcgtgcgccgctcgtgcctgaagcagacgctgcacaagctggaggccatgatgctcatcctgcaggcagagaccaccgcgggcaccgtgacgcccaccgccatcggagacagcatcc

SEQ ID NO: 10371 - DNA, 206 bp, Artificial Sequence; identical to SEQ ID NO: 10179
  Synthetic polynucleotide

SEQ ID NO: 10372 - DNA, 209 bp, Artificial Sequence; identical to SEQ ID NO: 9863
  Synthetic polynucleotide

SEQ ID NO: 10373 - DNA, 217 bp, Artificial Sequence
  Synthetic polynucleotide
cactcgggcctgtccccacaggtgagtacctcctgaccgtgctggcatctaatgccttcgagaacctgacgcagcaggtgcctgtgagcgtgcgcgcctccgagcgtgcgcgcctccctgccctccgtggctgtgggtgtgagtgacggcgtcctggtggccggccggcccgtcaccttctacccgcacccgctgccctcgcctgggggtgttcttt

SEQ ID NO: 10374 - DNA, 211 bp, Artificial Sequence; identical to SEQ ID NO: 10368
  Synthetic polynucleotide

SEQ ID NO: 10375 - DNA, 214 bp, Artificial Sequence; identical to SEQ ID NO: 10306
  Synthetic polynucleotide

SEQ ID NO: 10376 - DNA, 204 bp, Artificial Sequence
  Synthetic polynucleotide
catttctgttttcctgtagcaaaaccagaaatcctgacttacgacaggctcgtgaatggcatgctccaatgtgtggcagcaggattcccagagcccacaacaatagattggtatttttgtccaggaactgagcagaggtgagatgattatttttggcactgcttataatgcagaggggaaggactgcaattcacttgaatttca

SEQ ID NO: 10377 - DNA, 227 bp, Artificial Sequence; identical to SEQ ID NO: 10257
  Synthetic polynucleotide

SEQ ID NO: 10378 - DNA, 210 bp, Artificial Sequence
  Synthetic polynucleotide
ggccctgagcaatggcctggtgctggcggccctagctcggcggggccggcggggccactgggcacccatacacgtcttcattggccacttgtgcctggcctgcctggccgacctggccgtggctctgttccaagtgctgccccagctggcctggaaggccaccgaccgcttccgtgggccagatgccctgtgtcgggccgtgaagtatct

SEQ ID NO: 10379 - DNA, 206 bp, Artificial Sequence
  Synthetic polynucleotide
ctgagcaaagagaaaaacccaccgttgcagagactcatctcttcttcttctctcaccaggcttacaggaaatggataaatgacagaaggcagggacttgacttgaggagcctcttctaccaggcatcacattcaccaacaaccagctcttcttcctgagttatgctcatgtgagtagactgaggaaggggcatcagggatgagatg

SEQ ID NO: 10380 - DNA, 216 bp, Artificial Sequence
  Synthetic polynucleotide
cttactgatcgattactacttttccctccccatagttaccgtacacgagaagaaattcaggaagtaagaagtaagagtgaccctattatgcttctcaaggttatgcttctcaaggacaggatggtgaacagcaatcttgccagtgtggaagaactaaaggtacagtcacttgttcatggtggtttgaaggttggctttaaaagttgccacccctgg

SEQ ID NO: 10381 - DNA, 208 bp, Artificial Sequence
  Synthetic polynucleotide
gttgttgttgattggaatcgaggagctacaactttaatatatacccatgcctctagtaagaccagaaaagtagccatggtcttgaaggaatttattgaccattgaccagatgttggtaagagaattctcttagatgattcagagctaagttgaaactggcccattatctgagggcttaaagccaagagatagctacagtgagcaggag

SEQ ID NO: 10382 - DNA, 206 bp, Artificial Sequence
  Synthetic polynucleotide
agagcccacattgcaaggggcctacctgccggggggcctggtgcacagtagtgctggtgcgggaggaggggaggcacccccaggaacatcggggctgcggtgcgggaacttgcacagggagctctgcagggggcgccccaccgagttcgtcaaccactactgctgcgacagccacctctgcaaccacaacgtgtccctggtgctgg

SEQ ID NO: 10383 - DNA, 206 bp, Artificial Sequence
  Synthetic polynucleotide
tacgtgttccaaggggacagtagcccctgctcggccttcgagttccactgcctaagtggcgagtgcatccactccagctggcgctgtgatggtggccccgccccgactgcaaggacaaatctgacgaggaaaactgcggtatgggcggggccagggtgggggcggggcgtcctatcacctgtccctgggctcccccaggtgtggga

SEQ ID NO: 10384 - DNA, 205 bp, Artificial Sequence
  Synthetic polynucleotide
tttacaaagcgggttctaggagagagtggagagatggatgctctacgaatacagatggaagagcgattcatggcttccaatccttccaaggtctcctatcaatcagccaatcactactactttaaaacgaaaacaagaggaagtatctgctgtcattattcagcgtgcttacagacgccaccttttaaagcgaactgtaaaacaa

SEQ ID NO: 10385 - DNA, 218 bp, Artificial Sequence
  Synthetic polynucleotide
gcggcacgtgtgtggagggcggcggcgcgcaccgctgctcctgcgcgctgggcttcggcggccgcgactgccgcgagcgcgcggacccgtgcgccgcgcggacccgtgcgccgcgcgcccctgtgctcacggcggccgctgctacgcccacttctccggcctcgtctgcgcttgcgctcccggctacatgggagcgcggtgtgagttcccagtgcacc

SEQ ID NO: 10386 - DNA, 211 bp, Artificial Sequence
  Synthetic polynucleotide
agcccgaccccgggcaagcgcggcaagaagggcagccccagcgcgcagtccttcgaggagctgcagagccagcgcatcctggccaacgtgcgcgagcgccagcgccagcgcacccagtcgctcaacgaggccttcgcggcgctgcgcaagatcatccccacgctgccctctgacaagctgagcaagatccagacgctcaagctggccgcca

SEQ ID NO: 10387 - DNA, 205 bp, Artificial Sequence
  Synthetic polynucleotide
ttaagggtgacatctgcgctttaaagggtccgggtcagctgactcccgactctgtggagtctagctgccagggtcgcggcagctgcggggagagatgactgactggggagcgacccagcacggcgctcccggacagacgctgggggccgcggattctgggcttctggggaggctgtagggtttgggtgtttgccgcgatcttcct

SEQ ID NO: 10388 - DNA, 207 bp, Artificial Sequence
  Synthetic polynucleotide
caccgacccacacgtttatctcaggcaggagggagccaaagtttctctgatgtctcctgatcagcttcggaacaagtttccctggataaacacagagggagtgagtggctttggcgtcttatggtgaggcttgcttgcagaggggacagcttttttcctgaagatggagactaaggggtgctacacgttgggagtctcggtactcca

SEQ ID NO: 10389 - DNA, 217 bp, Artificial Sequence
  Synthetic polynucleotide
cgggtgagcacagtggccctggcccggggggccgcgcggggtgcctgccaggggggaggctcctaaggcccaccccggtgttttccccgccagctgccttccccgccagctgccttctgccagagcctgggcgccgccgcccccgaggtccgctgctgtgtggatgccgtgaacttcgtggccgagagcacgagagatcaggaggccaccggcgagg

SEQ ID NO: 10390 - DNA, 212 bp, Artificial Sequence; identical to SEQ ID NO: 10033
  Synthetic polynucleotide

SEQ ID NO: 10391 - DNA, 209 bp, Artificial Sequence
  Synthetic polynucleotide
gaacaccgagctcaggttggaatgatctaaggacacaaaagcatggggcctcggggctggggcggtgcgactaccggaggcgcaagttgcgcacggggtcccggcccgggagcgatacactgcctccccggtgtcagtgctccagacggtctccgccatgacagctgcgacgcgccgcgactgcgccggaaagcgcgccgctctgtttt

SEQ ID NO: 10392 - DNA, 213 bp, Artificial Sequence
  Synthetic polynucleotide
ctcccgtcacaagctcctgcctctcttttctccccatacaggacgggctctacgagtgcattctctgtgcctgctgtagcaccagctgccccagctactggcccagctactggtggaacggagacaaatatctggggcctgcagttcttatgcaggtgaggtgctccttaattgctttaagagaaattgaaactcaagcatccagaagtccaa

SEQ ID NO: 10393 - DNA, 205 bp, Artificial Sequence
  Synthetic polynucleotide
gcggagtgaatcagctcggtggtgtctttgtcaacgggcggccactgccggactccacccggcagaagattgtagagctagctcacagcggggcccggccggccgtgcgacatttcccgaattctgcaggtgatcctcccggcgccgccccactcgccgcccccgcggccctccactctcaacgccctctcttcatttcttactg

SEQ ID NO: 10394 - DNA, 208 bp, Artificial Sequence
  Synthetic polynucleotide
tttctgagaagcttcacgaggacaaggctgcagagccgggtgatgccctcgacctaatcattcacagtgcaagggagctgggccatgagccctccatgcaccatgcaggagctgaaggtaggtgctgacaggccgctccttctcccctcttttgcattcccagcaggtccctacaccaatgctgcatccccagagccacatcttgtgt

SEQ ID NO: 10395 - DNA, 215 bp, Artificial Sequence; identical to SEQ ID NO: 10278
  Synthetic polynucleotide

SEQ ID NO: 10396 - DNA, 206 bp, Artificial Sequence
  Synthetic polynucleotide
ccatctcttcaacaactatgacccaggaagccggccagtgcgggagcctgaggatactgtcaccatcagcctcaaggtcaccctgacgaatctcatctcacctcactggtaagctacccccaccctcatcttaagccaaaaatcccacttctggccccaaccgctgagctctgtcctaaagctcacttctggccctgaaatctcac

SEQ ID NO: 10397 - DNA, 212 bp, Artificial Sequence
  Synthetic polynucleotide
ggccgagcctgcctgcagtgagcgtcccactctgtccctgcaggagatcgtgctggtggtgttcttcgggacggagtacgtggtccgcctctggtccgcctctggtccgccggctgccgcagcaagtacgtgggcctctgggggcggctgcgctttgcccggaagcccatttccatcatcggtgagtcatgcctgccctgtggaggtcacgc

SEQ ID NO: 10398 - DNA, 205 bp, Artificial Sequence
  Synthetic polynucleotide
acggagtttgcgtttgaggtagttgtgcctgaccttgccctcatccgcttcttggtggaagattatgatgcctcctccaagaatgacttcattggccagagagagtaccatccccttgaacagcctcaagcaaggtgagtgtcaagagaaggggatggccaaggtggtgggaagcagggcctggcgtctcttgggctggggctgg

SEQ ID NO: 10399 - DNA, 208 bp, Artificial Sequence
  Synthetic polynucleotide
tgaacagttcagtggaggatgccaagacatcaatgaatgtggctctgcgcaggccccctgcagctatggctgttccaataccgagggcggttacctgtgtgctgtgtggctgtccacctggttacttccgcataggccaagggtaagcagtgctcttcctggtcatggttggagattctttcattcgtaatataattaagtatactga

SEQ ID NO: 10400 - DNA, 215 bp, Artificial Sequence; identical to SEQ ID NO: 10242
  Synthetic polynucleotide

SEQ ID NO: 10401 - DNA, 209 bp, Artificial Sequence
  Synthetic polynucleotide
agacttcgtccaggaatgcgctcaacgtctcccaggcctggcgccatgcgctgccctttgccaagatccgccgcgtgcaggaactgtgcgctggtgcgctggtgcgctgcagctgctgggctaccggcctgtgtactctgaggacgagcagcgcaacctcgcccttgatctggtgctgccacgaggcctgaacggcttcacttgggcat

SEQ ID NO: 10402 - DNA, 217 bp, Artificial Sequence; identical to SEQ ID NO: 9926
  Synthetic polynucleotide

SEQ ID NO: 10403 - DNA, 205 bp, Artificial Sequence
  Synthetic polynucleotide
ttggcaccatatgtgggtggatactaatgaatcctttcttaaccttcccagaacttttggagaaatcaatcagtagaaggcgggacaccgaagccatacatacagaaagccaaaatcctttattcatcctgcatgaatgagagtgagtgatgaagaaaactaaataaaatatttaccatccctatcctttagagttctattaatg

SEQ ID NO: 10404 - DNA, 205 bp, Artificial Sequence
  Synthetic polynucleotide
gcgctaacgcctgcccttgctctgcccctgcccttctccccagtgggccccaccatcctgaataagattgaagcggctctgaccaaccagaacctgtctgtctgtggatgtggtggaccagtgcctcgtctgcctcaaggaggagtggatgaagtaagcaacagtgtgggtgaggcccctttgcttgcgaccctggagaaaacct

SEQ ID NO: 10405 - DNA, 225 bp, Artificial Sequence
  Synthetic polynucleotide
aaccagcccctgggagcagctgccctgtcccccagggcccagggctgcctcacctccaaagtaggagccgtcggccagcttggtctccttgttgcccttggtgagcacgctgggtgagcacgctgaccacgccatgctggatgaagtacatcttcttgccaatggtgccttcccggatgatgtagtccccaggctggaagacctcgaaacgcagcttggtcagca

SEQ ID NO: 10406 - DNA, 215 bp, Artificial Sequence
  Synthetic polynucleotide
gtagcccctgctcggccttcgagttccactgcctaagtggcgagtgcatccactccagctggcgctgtgatggtggccccgactgcaaggacaaatctgaaaggacaaatctgacgaggaaaactgcggtatgggcggggccagggtgggggcggggcgtcctatcacctgtccctgggctcccccaggtgtgggacatgcagtgatttaggtgc

SEQ ID NO: 10407 - DNA, 208 bp, Artificial Sequence
  Synthetic polynucleotide
tcttatcagaaaggatacattgttttaattgttcctcattatatagaatgagagaacatcatttctctccttttcctcccaggtggccgtcgaggaccgaggaccgagtcaggcagctgcatgaagcccacagggactttggtccagcatctcagcactttctttccagtaagtcattttcagcttttatcacttaactttattgcat

SEQ ID NO: 10408 - DNA, 205 bp, Artificial Sequence
  Synthetic polynucleotide
ttctccatgctggctgctggggtcatgcacgcagtagccacggcctgcagcctgggcaagctggtgagctgtggctgtggctggaagggcagtggtgagcaagcaggatcggctgagggccaaactgctgcagctgcaggcactgtcccgaggcaagagtttcccccactctctgcccagccctggccctggctcaagccccagc

SEQ ID NO: 10409 - DNA, 207 bp, Artificial Sequence
  Synthetic polynucleotide
cctgcctgcagcagcgccgcgggagcgagggagccagggctgcgggtgtggcggggcccctgcccgggcgggcgaagggaacagctgcctgctcttcctgggtgggtttctttggcctctcgctggccctccacctgctgacgttgtgctgctacctagagttgcgctcggagttgcggcgggaacgtggagccgagtcccgccttg

SEQ ID NO: 10410 - DNA, 209 bp, Artificial Sequence; identical to SEQ ID NO: 10214
  Synthetic polynucleotide

SEQ ID NO: 10411 - DNA, 205 bp, Artificial Sequence
  Synthetic polynucleotide
aaccatttcataacagggaccaaagaattgaaccccgatccggttcacagaaaaataaactgctcacccgtctccacctgtcagtttcagggagaccttgcttgcatcaccatggggagtgtgataccagatggggccaaatgggatgatgactgtaatacctgccagtgcctgaatggacggatcgcctgctcaaaggtaggac

SEQ ID NO: 10412 - DNA, 214 bp, Artificial Sequence; identical to SEQ ID NO: 10306
  Synthetic polynucleotide

SEQ ID NO: 10413 - DNA, 217 bp, Artificial Sequence; identical to SEQ ID NO: 9877
  Synthetic polynucleotide

SEQ ID NO: 10414 - DNA, 212 bp, Artificial Sequence
  Synthetic polynucleotide
gctcactctccatggtgtctgagtgcctgttctcgctcatcaatggggacgacatgtttgtgacgttcgccgccatgcaggcgcagcagggccgcagcagggccgcagcagcctggtgtggctcttctcccagctctacctttactccttcatcagcctcttcatctacatggtgctcagcctcttcatcgcgctcatcaccggcgcctacg

SEQ ID NO: 10415 - DNA, 205 bp, Artificial Sequence
  Synthetic polynucleotide
cataatttcattgagcgcaaatatatctgaaacttctagcaataaaactagtagtgcagatacccaaaaagtggccattattgaacttacagatgggtgggtggtatgctgttaaggcccagttagatcctcccctcttagctgtcttaaagaatggcagactgacagttggtcagaagattattcttcatggagcagaactggt

SEQ ID NO: 10416 - DNA, 207 bp, Artificial Sequence
  Synthetic polynucleotide
gggtgcttcaggggtgtctgcaaaggagctctgcttcacagcagtgttcccttcttttaggggtctagcccagcagctggtggacccagcccggccaggagcaggagatttcaaccaagcagccatggagctaggggccacagtgtgtaccccacagcgcccactgtgcagccagtgccctgtggagagcctgtgccgggcacgcca

SEQ ID NO: 10417 - DNA, 205 bp, Artificial Sequence
  Synthetic polynucleotide
cgtgctcccggctacctttgtgtttttggctctgatgctttctattgttatccctccttttggcgaataccccgctttgacccttcacccctggatatatgtatgggcagcagtacaccttcttcaggtgcgcggactcggggtcaccattctcctctgtgggtttggggcacctgggtcacatgctgcttagaagggccctgac

SEQ ID NO: 10418 - DNA, 205 bp, Artificial Sequence
  Synthetic polynucleotide
ccagaactcagtttagatactgggacactggagaaaaagtcaggagcttgtgaagatcatagtatggctcaagctggtgaagtcgtgctgaagatgaaagaaagtggaagggatgacctgccattcatgtactagcactattgaaggaaaaattgggaaactgcaaggtgttcagcgaattaaaggtaatgtgtctggtgttgat

SEQ ID NO: 10419 - DNA, 211 bp, Artificial Sequence; identical to SEQ ID NO: 10368
  Synthetic polynucleotide

SEQ ID NO: 10420 - DNA, 207 bp, Artificial Sequence
  Synthetic polynucleotide
gttacggctgtctccacccctcagggctaaggtgccctgaggcagagggccaagtcactcacctggactgctgcagacagtgcaagcggaaggtgacagtgcctgcctgtggtctctgtgcggagtccaaagcggctcaggcgttccccctgtggcatgccattgggacagcctcaggtttctgctctctctagacacccccgcacc

SEQ ID NO: 10421 - DNA, 207 bp, Artificial Sequence
  Synthetic polynucleotide
ctgaccccccgcgcgcgaggcagcgatgacgtgggccctgccctcccacgccccattccccttccctgaggccaccgccccctccttgcaggtccagcaaccaaccacggcatcagcctgcaggagatcccacccgagcggcgacggaagctggagaaggcgcggccgggccagttctcttgagaagtgaggcccggccccggacag

SEQ ID NO: 10422 - DNA, 208 bp, Artificial Sequence
  Synthetic polynucleotide
ggcggggggccccgggcgcggctgcgggccctgcgagcccccctgcctctgcggcccagcgcccggcgccgcctgccgcgtcaactgctcgggccgcgggccgcgggctgcggacgctcggtcccgcgctgcgcatccccgcggacgccacagcgctgtgagtagcgggcccagcggcacccgggagaggccgcgggacgggcgggcg

SEQ ID NO: 10423 - DNA, 207 bp, Artificial Sequence
  Synthetic polynucleotide
ggaagcagagtcattgtgaccagaggggtttgtgtggctgaagaggcaggaggaacagtgtatccacagcgtgggaccatgccaggcacaaaacggtttcggtttcaacatgtcattgagaccccggagcctggcaagtgggaggtgagaccccttcttcatgttggctttctgtgctgattcctagaattatttttcatccagtct

SEQ ID NO: 10424 - DNA, 225 bp, Artificial Sequence; identical to SEQ ID NO: 10236
  Synthetic polynucleotide

SEQ ID NO: 10425 - DNA, 219 bp, Artificial Sequence
  Synthetic polynucleotide
acctgggagaagacgcccgcttccgcatgttcagcaagcagggagtgttgactctggagattagaaagccctgcccctttgacgggggcatctatgtctgcgggggcatctatgtctgcagggccaccaacttacagggcgaggcacggtgtgagtgccgcctggaggtgcgaggtgaggagccctcggggccagggcctgggagatgggaagagcggg

SEQ ID NO: 10426 - DNA, 205 bp, Artificial Sequence
  Synthetic polynucleotide
agatttttctccctccagacgtgccgggcctgcagtgcgtgaagtacattcagggactccagtggggaactcagcaaatactcagtgaacacaccaggatggatgacgcaccaagggccccatgacagattcatcgaacttaatagtacccttttcctgctgagattcatcaatgccaatgtcattgctgaactgttcttcaggc

SEQ ID NO: 10427 - DNA, 209 bp, Artificial Sequence
  Synthetic polynucleotide
ttctcagttttgtacccattaattaaaacaaattatcttcatcaatttattcagcgaataggtcatggtgataaaaaccacaccgatgctgaccgttctcctatcctatttttctccagtttattgattgtgtgtggcaaatgtcaaaacaggtaaggaatatgagggatgaaaatacattcaactcattgtttaaattaaacatttta

SEQ ID NO: 10428 - DNA, 217 bp, Artificial Sequence
  Synthetic polynucleotide
ccaggcgcccggcggggcagcgcgggcctggccaagaagtgccccttctcgctggagctggcggagggcggcccggcgggcggcgcgctctacgcgcccatcgcgcccatcgcgcccggcgccccaggtcccgcgccccctgcgtccccggccgcgcccgccgcgcccccagttgcctccgaccttggcccgcggccgccggtgagcctagacccgc

SEQ ID NO: 10429 - DNA, 205 bp, Artificial Sequence
  Synthetic polynucleotide
cctgtgtgattgctgttttaagttcgataccttgtctccaatccactctaagatgtcagcacactcctgtacatactgctggaacttcagggcccgcagcaacaactggtcacccttctccagggtcagctctaacagcaggtcccacaggtggcgtagctcctctatatgggcctttaggaaagaggggcaaaaccactcagcc

SEQ ID NO: 10430 - DNA, 217 bp, Artificial Sequence
  Synthetic polynucleotide
gaggacctgggggccgccatggaggaggccctcatcctggacaacaagtacacggagcacagcaccgtgggcctcgcccagcagtgggaccagctggaccagctgggccagctgggcatgcgcatgcagcacaacctggagcagcagatccaggccaggtacccgggagggctgtgggccaggctcagcccagagcagggggaggaaaagacacagt

SEQ ID NO: 10431 - DNA, 229 bp, Artificial Sequence
  Synthetic polynucleotide
gcccttcttattcttctcgtagaacgggaacttcgcgatgatgtactggtagatgccggacagcgtgagcctcttctccgcgctctcgcggatcgccatggcgatgagcgccacggcgatgagcgccacgtacgagtacgggggcttctgcgccgggtccggcttctccggggctgtcccgccgccacccccaccgcccttgcctgggctcggcggcggcccttctggc

SEQ ID NO: 10432 - DNA, 206 bp, Artificial Sequence
  Synthetic polynucleotide
ccttcttctccctcttcttcctcttcactctgctctcttctcttcttttcccctttcctctcctctccctttcctcaggtcacagcggagtgaatcagctcagctcggtggtgtctttgtcaacgggcggccactgccggactccacccggcagaagattgtagagctagctcacagcggggcccggccgtgcgacatttcccgaa

SEQ ID NO: 10433 - DNA, 208 bp, Artificial Sequence
  Synthetic polynucleotide
ccagcagctcctacaccggcggcccctgcaccagccccctcctggcccctgtcatcttctgtcccttcccagaaaacctaccagggcagctacggtttccggtttccgtctgggcttcttgcattctgggacagccaagtctgtgacttgcacggtcagttgccctgaggggctggcttccatgagacttcaatgcctggccgtatcc

SEQ ID NO: 10434 - DNA, 212 bp, Artificial Sequence; identical to SEQ ID NO: 10414
  Synthetic polynucleotide

SEQ ID NO: 10435 - DNA, 206 bp, Artificial Sequence
  Synthetic polynucleotide
catcctgttcatccgggccgctcgccgcgtgcattcaggcacttaccaggtgacggtgcgcattgagaacatggaggacaaggccacgctggtgctgcagggcaggttgttggtgcgtggccaaggcctccttgagcccccttgtttcccttccctgggctgggctgctggggccaagggtggggccaggggacccaacccacagc

SEQ ID NO: 10436 - DNA, 205 bp, Artificial Sequence
  Synthetic polynucleotide
gactttgaaacatgctcttaatatttggtgcaggacatttcaaagctgagccctcttgcattgcctttttcagatgacctcaagcagtttggcctaacaaacaaccagtattccgttccgaggttgcatcagatccctgaagctcaccaaaggcacaggcaagccactggaggttaattttgccaaggccctggaactgaggggc

SEQ ID NO: 10437 - DNA, 205 bp, Artificial Sequence
  Synthetic polynucleotide
attccaaaagctgccattacaacatctctgtagacccatttccttttgagcacttcagagggggaggaggagtttgtgatgattgtgagcataacactacatacaggtaagtagcaaataaattcctgagttggtttggaggcctgtgtgcttctatctacaatgcatattattttaaattatgttattgctatcttatttaagg

SEQ ID NO: 10438 - DNA, 205 bp, Artificial Sequence
  Synthetic polynucleotide
ttccttaaagaagtaatgctgatccaggcttttttctttttctgtgactctttgacacgtaataatattgacttttctttctttccagacactacaacaacaacaggagtgcaaacttctctacagccgaaaagagggtcaaaggcaagaaaacaaaaacaaaaatagatataaaaacatcctgccctgtaagtatcaatattcc

SEQ ID NO: 10439 - DNA, 205 bp, Artificial Sequence
  Synthetic polynucleotide
accgagccacatgtcttcgatctacaaagttcaccatctataacaacatgttctgtgctggcttccatgaaggaggtagagattcatgtcaaggagatagatagtgggggaccccatgttactgaagtggaagggaccagtttcttaactggaattattagctggggtgaagagtgtgcaatgaaaggcaaatatggaatatata

SEQ ID NO: 10440 - DNA, 204 bp, Artificial Sequence
  Synthetic polynucleotide
ctgtgtgccctgctccaggtgatggtcctggcgctgatgacggtcgagctgttcggcatgatgggcctcatcggaatcaagctcagtgccgtgcccgtggtggtcatcctgatcgcttctgttggcataggagtggagttcaccgttcacgttgctttggtatgggagacatttgaagcaaaaactttgtgaaaaaacaaccca

SEQ ID NO: 10441 - DNA, 205 bp, Artificial Sequence
  Synthetic polynucleotide
aaaacctggctggttgggaacaagcttgtcactgtgacgacaagcgtgggaaccgggacccggtcgttactaggcctggactcgggggagctgcagtccgtccggcccggagtcgaggtgactgcaccttcctttcctccgcgcctgccagcctcgacaccggctgtcccgagcccaggcccacgtggcaccctcgtaccagcct

SEQ ID NO: 10442 - DNA, 215 bp, Artificial Sequence; identical to SEQ ID NO: 10042
  Synthetic polynucleotide

SEQ ID NO: 10443 - DNA, 206 bp, Artificial Sequence
  Synthetic polynucleotide
agccattggggaagagcctccccaccaagcctctttctctctcttccagatatcgatgagtgtcaggatcccgacacctgcagccagctctgcgtgaaccgaacctggagggtggctacaagtgccagtgtgaggaaggcttccagctggacccccacacgaaggcctgcaaggctgtgggtgagcacgggaaggcggcgggtggg

SEQ ID NO: 10444 - DNA, 223 bp, Artificial Sequence
  Synthetic polynucleotide
gacaaggcgcggctgagccccgacccccggggccgcccctgagccccgcctctccctccccggcagaaacgtccgcgcggtgcgggtggtcctgggagcccataacctctcccataacctctcgcggcgggagcccacccggcaggtgttcgccgtgcagcgcatcttcgaaaacggctacgaccccgtaaacttgctcaacgacatcgtgattctccaggtg

SEQ ID NO: 10445 - DNA, 211 bp, Artificial Sequence; identical to SEQ ID NO: 10229
  Synthetic polynucleotide

SEQ ID NO: 10446 - DNA, 205 bp, Artificial Sequence
  Synthetic polynucleotide
gtgtctccagccgtgagctggtgaagaaggtctccgatgtcatatggaacagcctcagccgctcctacttcaaggatcgggcccacatccagtccctcttccttcagcttcatcacaggttggagcccagtaggtgggaatcttatccatgacccacttcttcaaaaccctccatggtttacagaacccttttaagaactgtaag

SEQ ID NO: 10447 - DNA, 229 bp, Artificial Sequence
  Synthetic polynucleotide
ctgtgtgcaatgtagggggtcatgaactttgaaggatccactttcttccggatgaccttcctcctctccaccggctttgctgatgctggctgtgccagtgctggctgtgccagagctggctgtgccagagctggtttggaagtttctgattgctcatagtcagatgtccttgttgtcgtagtctcataaatttttgttattgtctgaaaatttgatatgcagttcaaca

SEQ ID NO: 10448 - DNA, 208 bp, Artificial Sequence
  Synthetic polynucleotide
gggcagggatggggcaggaggcaggggcaagatggaggcctgggggaacaaggctgtctcccatctcatctgacttctcttggtttggttgtcagggccccgggcccccgtggcctgcctggtgagagaggtcgccctggagcccctggccctgctgtaagtactcctggccccttgggggatccctgagctctggaaggggctcccc

SEQ ID NO: 10449 - DNA, 205 bp, Artificial Sequence
  Synthetic polynucleotide
ctggagtgtcgagtccctcagccttgcaattctggggtggagggaagagtgggcagcccacccacccactttctcctggcagccaacagcatgattgacagacaggaagccgcgcctgctcttccccaccaactccagcagccacctggtggccttgcaggggcagccattggtcctggagtgcatcgccgagggcttgtgagtc

SEQ ID NO: 10450 - DNA, 205 bp, Artificial Sequence
  Synthetic polynucleotide
atggggagagacagcccttgctgagcagatcccgtccttgccctctcccagggaggacccgtggcgtgtggcgaagatggtcaagtcctacctgcagcagcagcacaacatcccacagcgggaggtggtcgataccactggcctcaaccagtcccacctgtcccaacacctcaacaagggcactcccatgaagacgcagaagcgg

SEQ ID NO: 10451 - DNA, 204 bp, Artificial Sequence
  Synthetic polynucleotide
gctgtggactgagttacctttgtgtcctgtgttggttccacagggattgtgtgcacactctgcattccagggacacgtggctgaagaaagcaagagtggtggtgaggcttggagaagtaccctacaaggtaactggagctggggggtccctgtggggagtggtgacacaggcctgtagctgagcgggagagctgggggcagaga

SEQ ID NO: 10452 - DNA, 205 bp, Artificial Sequence
  Synthetic polynucleotide
ctgttatcttctctcctaggctgacacaggcaagaatttagtcacgctccccaatacaactgccactgcaattctgtgcagtgacgagactatctggctggctggagcctgaagttctcttttcagggcctcgtcaaggtgagatgatctagagaaaacttcacacgggagtgaacaaatgtttctttcaaagagattaagagtt

SEQ ID NO: 10453 - DNA, 206 bp, Artificial Sequence
  Synthetic polynucleotide
atttggggacacgccactgacacagagcatccaggccaatgtgacggtggcccccgagcgcctggtgcccatcattgagggtggctcataccgcgtgtggtgtggtcagacacacgggacctggtgctggatgggagcgagtcctacgaccccaacctggaggacggcgaccagacgccgctcagtttccactgggcctgtgtggc

SEQ ID NO: 10454 - DNA, 209 bp, Artificial Sequence
  Synthetic polynucleotide
ccgcaaccacacctacaatacctatatcgggcagggttacatcatccccgggatggaccaggggctgcagggtgcctgcatgggggaacgccggagaattggagaattaccatccccccgcacctcgcctatggggagaatggaactggtaggggcgttccccagccaccacctcagctcctcctccgaactgcccattgtgtctaggc

SEQ ID NO: 10455 - DNA, 206 bp, Artificial Sequence
  Synthetic polynucleotide
cgcctggtgcccttctccagccccaggccccccggagagccgccgggtggggagcccctgatggaggactgcgagaagagcagcgacacttgcaaccccctcccctgtcaggtatcccgggcgacgggcgggcgagggaggaccgggcgtggcagcggtggtgcgtctaccccgctcacccagctctgctctctggctgcaggcgc

SEQ ID NO: 10456 - DNA, 212 bp, Artificial Sequence; identical to SEQ ID NO: 10230
  Synthetic polynucleotide

SEQ ID NO: 10457 - DNA, 205 bp, Artificial Sequence
  Synthetic polynucleotide
gggagaagtgggagctggacctggacatcaaggaggtcttcgtccaccccaactacagcaagagcaccaccgacaatgacatcgcactgctgcacctggctggcccagcccgccaccctctcgcagaccatagtgcccatctgcctcccggacagcggccttgcagagcgcgagctcaatcaggccggccaggagaccctcgtga

SEQ ID NO: 10458 - DNA, 205 bp, Artificial Sequence
  Synthetic polynucleotide
atagtaggggtggagatgccaagggcacccaggagaggctctcggcatcaggaagggcctggcccagagatgcctcccctccctccctgcccccaggagtgagtggttcaccgtcttggagcattaccgccgcacccactgcgtggtgccagagctcatcattggcaatggctactacttccgcgtcttcagccagaatatggtt

SEQ ID NO: 10459 - DNA, 205 bp, Artificial Sequence
  Synthetic polynucleotide
acctggggaacccctagccggcatggacacgactcttgtctacaagcacctgccggctccgccttctgcagccccgctgccagggctggactcctcggccggccctgcaccccctactgtgtgtgggtcctgagggtcagcaggtgagcggggagtgggggtcagggtgggctcttcaaggagcccaggacctacggggcggatg

SEQ ID NO: 10460 - DNA, 205 bp, Artificial Sequence
  Synthetic polynucleotide
gcctaagtgtcttccccggaggtgagattatctccgcctgtgctggacacctccctttctcctgcagccatggatgccgctctgctcctgaacgtggaaggaaggggtcaagaaaaccattctgcacgggggcacgggcgagctcccaaacttcatcaccggatcccgagtgagtggggcccctccggagcagacagggtccccc

SEQ ID NO: 10461 - DNA, 206 bp, Artificial Sequence
  Synthetic polynucleotide
tatgagtaaccagagtcttattcttcctcatctccaggtctatggattctggggtgccacaactcagactttcggaacagaggcatgaccgccttactgaaatgaaggtttctagttgtgacaagaacactggtgattattacgaggacagttatgaagatatttcagcatacttgctgagtaaaaacaatgccattgaaccaaga

SEQ ID NO: 10462 - DNA, 209 bp, Artificial Sequence
  Synthetic polynucleotide
agacagtccccgctacaaccccagccctcccaagactggggctaccgtctgaccctgcaagccccctcaggtgttcaccacatcaagcgccgggacatcgggacatcgtgctcaagtgggagctgggggagggcgcctttgggaaggtcttccttgctgagtgccacaacctcctgcctgagcaggacaagatgctggtggctgtcaag

SEQ ID NO: 10463 - DNA, 206 bp, Artificial Sequence
  Synthetic polynucleotide
ttttcttattcccacagtgtatcggctagcctatctccggctaaatacactttgtgaacgccttctgtctgagcacccagaattagaacatatcatctggtctggacccttttccagcacaccctgcagaatgagtatgaactcatgagagacaggcatttggaccaagtaagaaaatcaagcacttcaccttctctcctccctac

SEQ ID NO: 10464 - DNA, 206 bp, Artificial Sequence
  Synthetic polynucleotide
gcccgcccattgctgccctactggctgctggtgttcctggctgccctcaatgccctgctgcagtggctgctgcggccactggtgctctacgcacccctgccctgctgaacccctacacgctggccgtggccaacaccaccttcaccgtcagcaccgacaaggctcagcgccatttcggctatgagcccctgttctcgtgggaggat

SEQ ID NO: 10465 - DNA, 205 bp, Artificial Sequence
  Synthetic polynucleotide
accctttgcaagaaaaacggcttcaaagtctacgtatacccacagcaaaaaggggagaaaatcgccgaaagttaccaaaacattctagcggccatcgagggagggctccaggttctacacctcggaccccagccaggcgtgcctctttgtcctgagtctggatactttagacagagaccagttgtcacctcagtatgtgcacaat

SEQ ID NO: 10466 - DNA, 205 bp, Artificial Sequence
  Synthetic polynucleotide
aaggtttttgctgacattcagagtgaagaaattttacaacataaccaaaatatgtctggattggagaaagtttctaaaatatcaccttgtgatgttagttagtttggaaacttcagatatatgtaaatgtagtatagggaagcttcataagtcagtctcatctgcaaatacttgtgggatttttagcacagcaagtggaaaatct

SEQ ID NO: 10467 - DNA, 211 bp, Artificial Sequence
  Synthetic polynucleotide
caggagagtggctcagcagctctggaacctgcagcccccctgccccgccacagtccgcttctggctgaccccgccggctttcccggcgcaggtactacgagaccgagaccggcagcatcaagccgggtgtgatcggtggctccaagcccaaagtggcgacgcccaaagtggtggacaagattgctgaatacaaacgacagaacccgactat

SEQ ID NO: 10468 - DNA, 217 bp, Artificial Sequence; identical to SEQ ID NO: 10110
  Synthetic polynucleotide

SEQ ID NO: 10469 - DNA, 211 bp, Artificial Sequence; identical to SEQ ID NO: 9917
  Synthetic polynucleotide

SEQ ID NO: 10470 - DNA, 211 bp, Artificial Sequence
  Synthetic polynucleotide
ttctcgccctgcaggacggggaggtttactgcatcgacgcgcggttctacgggaacgtcagccggttcatcaaccaccactgcgagcccaacctggtgcccgtgcccgtgcgcgtgttcatggcccaccaggacctgcggttcccccggatcgccttcttcagcacccgcctgatcgaggccggcgagcagctcgggtacgcaccgccccg

SEQ ID NO: 10471 - DNA, 205 bp, Artificial Sequence
  Synthetic polynucleotide
cctggcctctggaaagtccatgccccatcctcctgcagccctgcccttccctccccatctcgctcattcccccttctcttctttgaggtgtgcccggccggccggggcaggcgccctggagcctggcgccccaggcagctgctacctggatgcagggctgcggcggcgcctgcgggaggagtggggcgtgagctgctggaccctg

SEQ ID NO: 10472 - DNA, 205 bp, Artificial Sequence
  Synthetic polynucleotide
gggcgtgtggagcggccccgtggtaatctctcttctaccactttttcatgccttgcagcactttgcccatagggaggaaggggaagtgccccagctcgctcgctgtacatggcctggctggagaccctgtcccaggacctcagacctccagtcatcctgatccgaggaaaccaggaaaacgtgctcaccttttactgccagtaac

SEQ ID NO: 10473 - DNA, 214 bp, Artificial Sequence; identical to SEQ ID NO: 10306
  Synthetic polynucleotide

SEQ ID NO: 10474 - DNA, 209 bp, Artificial Sequence
  Synthetic polynucleotide
tgctactggcgacctgcgagttgtctcaggtaatgtgacctttgcccctggggaaaccattcaaaccttgttgttagaggtcctggctgacgacgttccgacgttccggagattgaagaggtgagaggactggctagtatagaatgacactgtaaatcataccgtatctatagtgactagaacagatggccattgtaacattttggaga

SEQ ID NO: 10475 - DNA, 210 bp, Artificial Sequence
  Synthetic polynucleotide
aagacggggaggtgggagggggacacgggaggtgagtcccgagctcacggcgtcccccaccgccacagcttaccgcatccacgtgaacttgagcactgtgagcactgtggggattctccgtgctctggactcgggctaccaggtggagctgcgaggccgcacggagctgaaggtgaggcagggccccaacccctcccggaggccccgccc

SEQ ID NO: 10476 - DNA, 204 bp, Artificial Sequence
  Synthetic polynucleotide
gaggcctgccgctcctacagccacgtggtgctcaaggaggtgcgcttcttcaacctgcaggtgctctacccgctgctcagcgaccccgcgctcaacctacgacgcatcgtgcacctggtgcgcgacccgcgggccgtgctgcgctcccgggagcagacagccaaggctctggcgcgtgacaacggcatcgtgctgggcaccaac

SEQ ID NO: 10477 - DNA, 207 bp, Artificial Sequence; identical to SEQ ID NO: 10220
  Synthetic polynucleotide

SEQ ID NO: 10478 - DNA, 217 bp, Artificial Sequence
  Synthetic polynucleotide
cagcgcgttcctgctcaggtccagctcccggagctcggccaggccgctgaagagcgcgggctgcaggtaggccagcctgttgcccgccagcaccagctcgcgcaggctgcgcaggctgcccaggccgcggaacgccgcatcggggagcaccgccaggctattccagccgaggttgaggtcccagaggctgccgaggccctcgaagagcccgtcctcc

SEQ ID NO: 10479 - DNA, 217 bp, Artificial Sequence
  Synthetic polynucleotide
agcctcggacccggagcccggccctgccgggcgggagaagccccggcccctgcagggcgctagaggggggccaggccgaggtccggctgcgcagaaacgccgctgcgcagaaacgccagctccgcggggaggctgcaggggctggcggggggcgccccggggcagaaggagtgcaggcccttcgaagtgtacctgccctcgggaaagatgcgaccta

SEQ ID NO: 10480 - DNA, 215 bp, Artificial Sequence
  Synthetic polynucleotide
ctactctttgtgcccagctctctgcccgtgctgacagccctgctctgtgccgccacctgatgccagatgggagcctcccagaggcccagagcctgtggcccagagcctgtggccaaggccactgttttgctagggccccagggcccacatttgggaaagttcttgatgtaggaaagggtgaaaaagcccaaatgctgctgtggttcaaccaggca

SEQ ID NO: 10481 - DNA, 205 bp, Artificial Sequence
  Synthetic polynucleotide
gccccgttccttcatttcacgttgagctgtgcagagaaggcaagaaccttctgaagcattttcgattccgtgacttggaagaggatccgtacctccctggttggtaatccccgtgaactgattgcctatagccagtatccccggccttcagacatccctcagtggaattctgacaagccgagtttaaaagatataaagatcatgg

SEQ ID NO: 10482 - DNA, 205 bp, Artificial Sequence
  Synthetic polynucleotide
accgatctgatgtgtttgaggcctggcggctgctgctcacatctgctccctccctggccaccagccccgccttccgctacgacctgctggacctcactcgctcggcaggcagtgcaggagctggtcagcttgtactatgaggaggcaagaagcgcctacctgagcaaggagctggcctccctgttgagggctggaggcgtcctgg

SEQ ID NO: 10483 - DNA, 208 bp, Artificial Sequence; identical to SEQ ID NO: 10348
  Synthetic polynucleotide

SEQ ID NO: 10484 - DNA, 221 bp, Artificial Sequence; identical to SEQ ID NO: 10239
  Synthetic polynucleotide

SEQ ID NO: 10485 - DNA, 206 bp, Artificial Sequence
  Synthetic polynucleotide
gggtcttactacggagcacatttgcagtgaattgaggaatttgaatattttgaagaatgtttccgctgaatattcaatctacatcgcttgcgagccttcccttccccttcagcgaacaatgaaatacatgtggccattgtaagtataagacccattcacacctcattattcgatggcaaggcagttcggttaaccagtgtctgaat

SEQ ID NO: 10486 - DNA, 205 bp, Artificial Sequence
  Synthetic polynucleotide
agaaacatacatgataataaagtttctggtccgttgtctggcaattcagctaatcatcatgctgataatcctagacatggttcaagtgaggactacctacctacacatggtgcacaggctaagtagtgacgtatgtaatatattatcattaaggtgataaaatagttctaatatttgtcatataacctagtatttccatttcaaa

SEQ ID NO: 10487 - DNA, 209 bp, Artificial Sequence
  Synthetic polynucleotide
atcttcagcaggctttgttgtgttaagtctcagcacatgttggatgggtggccatccagcggacatctccttcctgttgtttcagatacagccaggctgataggctgatgccctgaagtatgtcggcatcgaaagagaaatggaaatcccttgacatctgctacctcctcccccctcctctgaaacagctgccttagcttcaggaacct

SEQ ID NO: 10488 - DNA, 210 bp, Artificial Sequence
  Synthetic polynucleotide
gcgcccggtaatgaatgtggaggatgaggtgggaggagggacggcagccctgcttctcttctgcccagcttcaaggagcggttccatgccagcgtgcgcagcgtgcgcaggctgacgcccagctgcgagatcaccttcatcgagtcggaggagggcagtggccggggcgcggccctggtctcggcggtggcctgtaagaaggcctgtatg

SEQ ID NO: 10489 - DNA, 206 bp, Artificial Sequence
  Synthetic polynucleotide
ttccacgagggccccagttggctgcccagaacttgggcatcagcctggccaacttgttgctgagcaaaggagccaaaaacatcctggatgttgcacggcacggcagcttaacgatgcccattaactggtttgtggggcacagatgcctgggttgctgctgtccagtgcctacatcccgggcctcagtgccccattctcactgctat

SEQ ID NO: 10490 - DNA, 213 bp, Artificial Sequence
  Synthetic polynucleotide
gtgggtctttcctttgagtgacagttcaatcctgtctcttctgtagtgtctgtcacctgcaaatccggggacttcagctgtgggggccgtgtcaaccgctgcattctgcattcctcagttctggaggtgcgatggccaagtggactgcgacaacggctcagacgagcaaggctgtcgtaagtgtggccctgcctttgctattgagcctatctg

SEQ ID NO: 10491 - DNA, 208 bp, Artificial Sequence
  Synthetic polynucleotide
cacgcactaccacgagcacggctccctctacgactttctgcagagacagacgctggagccccatctggctctgaggctagctgtgtccgcggcatgcggcatgcggcctggcgcacctgcacgtggagatcttcggtacacagggcaaaccagccattgcccaccgcgacttcaagagccgcaatgtgctggtcaagagcaacctgca

SEQ ID NO: 10492 - DNA, 210 bp, Artificial Sequence
  Synthetic polynucleotide
accgaccccggccccatgctggccatccctgccatggccaccaacccccagaacgccgccagccgccggacgcccaacaacccggggaacccatccaatccatccaatcccggcccccccaagacccccgagaatagccttatcgtcaccaaccccagcggcacccagaccaattcagctaagactgccaggaaacccgaccacaccaca

SEQ ID NO: 10493 - DNA, 212 bp, Artificial Sequence; identical to SEQ ID NO: 10283
  Synthetic polynucleotide

SEQ ID NO: 10494 - DNA, 210 bp, Artificial Sequence
  Synthetic polynucleotide
gggggctttggaggtggtgctggaggaggtgatggtggtattctgactgctaatgagaagagcaccatgcaggaactcaattctcggctggcctcttacttctcttacttggataaggtgcaggctctagaggaggccaacaacgacctggagaataagatccaggattggtacgacaagaagggacctgctgctatccagaagaactac

SEQ ID NO: 10495 - DNA, 205 bp, Artificial Sequence
  Synthetic polynucleotide
tgatttttctctattgttttcatctttcaggacactaaaggagactcagccatggtcctctcccaaaggttctgaaggataccttgcagccacctatccatccaactgtcggccagaccagtccccgagccaggaaatccatgagcctggacatggggcaaccttctcaggccaacactaagaagttgcttggttagtttatcta

SEQ ID NO: 10496 - DNA, 205 bp, Artificial Sequence
  Synthetic polynucleotide
gaagagcctccccaccaagcctctttctctctcttccagatatcgatgagtgtcaggatcccgacacctgcagccagctctgcgtgaacctggagggtgggtggctacaagtgccagtgtgaggaaggcttccagctggacccccacacgaaggcctgcaaggctgtgggtgagcacgggaaggcggcgggtgggggcggcctca

SEQ ID NO: 10497 - DNA, 210 bp, Artificial Sequence
  Synthetic polynucleotide
gcggccaaagctggcatgaaccgggtattcctgcagcggctcctgtggctcctgcggctgctgttcccccgggtcctgtgccgggagacggggctgctggggctgctggccctgcactcggccgccttggtgagccgcaccttcctgtcggtgtatgtggcccgcctggacggaaggctggcccgctgcatcgtccgcaaggacccgcgg

SEQ ID NO: 10498 - DNA, 223 bp, Artificial Sequence
  Synthetic polynucleotide
agagccatgaggcagagcatacgcagcctgtacccagtggtgccgagcctctggcggtgccaagcctcacaccacccccacccacagatccactgtgcgacgagctgtgccacgagctgtgccgcacggtgatcgcagccgctgtcctcttctccttcatcgtctcggtgctgctgtctgccttctgcatccactgctaccacaagtttgcccacaagccacc

SEQ ID NO: 10499 - DNA, 211 bp, Artificial Sequence
  Synthetic polynucleotide
cgctcctcagtatacctcctgtcactgtcccttcaggactggagccgggcctcgtctttcttggcttcctcctggtggttgggatggggctggctggggctggctggggccttcctggcccattatgtgaggtgagtagtggaatgaggtaagtaggaagtgagcttgtgccagaaatggaagtctgcagcaaaaacagcaggctgggttc

SEQ ID NO: 10500 - DNA, 205 bp, Artificial Sequence
  Synthetic polynucleotide
tgttctcatcctcttttctatagccaacccaacccgagcaggcggcagagagccgtatccaggctcagcagaagtgatccgggagtccagcagcaccacggacgggtatggtcgttgggatagtagccgctgccgccctgtgcatccttatcctcctctatgccatgtacaagtacagaaaccgggatgaaggctcataccatgt

SEQ ID NO: 10501 - DNA, 219 bp, Artificial Sequence
  Synthetic polynucleotide
acccgtccccgcccgcagggggcgccctgctctggctcagcggacacgcggggactcaggcccagggcgctgcccgggtggccgcggcgctggacgacggcgcggcgctggacgacggctcggcccttggccgcttcgagcggatgctggcggcgcagggcgtggatcccggtctggcccgagccctgtgctcgggaagtcccgcagaacgccggcagc

SEQ ID NO: 10502 - DNA, 209 bp, Artificial Sequence
  Synthetic polynucleotide
gtggaagtggctctcctgcgccttgcggaaggcgtagcagctctggccgtagtcgcggaaggtctgtagatctagctgcgccacgggctgggccgggccgggcagggcagggggctaccaccccgcgccgcagaggggctctctgcgccgtctgagccggagctgggggactcgaacaggtcgcaaatgccggagtctcccgggagcgg

SEQ ID NO: 10503 - DNA, 215 bp, Artificial Sequence
  Synthetic polynucleotide
cggctttctttttggcctcggcggcagcggctgccaccacactccccggctttcggccccgtttcttgggaatggcctgagggtcggcctcagcttttcgcttcctggcttcctgccggggcgtttgatcaccatgacctgggtggatgtggtggccccacccccctcagccttgccccctggcgaagtttgaaaaggcatcttgacaaggagct

SEQ ID NO: 10504 - DNA, 217 bp, Artificial Sequence
  Synthetic polynucleotide
cccctcctcacttctgcctcacagtggccaggtcctgtgccagattgtccctctcaacctccagccgggcgctgttggcggtgagttgatcgagccgcagccgcagctgccgcagctctcgcagctcagcctggtagacgtctgccagcttggtgggctccttggcccgcagctggttcagctcagcagccagcgccttgttttgctgttccaggaa

SEQ ID NO: 10505 - DNA, 209 bp, Artificial Sequence
  Synthetic polynucleotide
cttaagaagggacggggccccacgctgcgcacccgcgggtttgctatggcgatgagcagcggcggcagtggtggcggcgtcccggagcaggaggattccgggattccgtgctgttccggcgcggcacaggccaggtgaggtcgcagccagtgcagtctccctattagcgctctcagcacccttcttccggcccaactctccttccgcag

SEQ ID NO: 10506 - DNA, 209 bp, Artificial Sequence
  Synthetic polynucleotide
cctgggagctgcgcttctcgtaccgcgcgcgctgcgagccgcctgccgtcgggaccgcgtgcacgcgcctctgccgtccgcgcagcgccccctcgcggtgcggtgcggtccgggactgcgcccctgcgcaccgctcgaggacgaatgtgaggcgccgcgtgagtcctgcgttcgaccccaccccgtcccagccggggaccccggcccct

SEQ ID NO: 10507 - DNA, 209 bp, Artificial Sequence
  Synthetic polynucleotide
ccctgaagaagacggcggggaggagtcgggcgccgaggagtccggcccggaagagtccggcccggaggaactgggcgccgaggaggagatggaggccgggaggccgggcggccgcggcccgtgctgcgctcggtgaactcgcgcgagccctcccaggtcatcttctgcaatcgcagtccgcgcgtcgtgctgcccgtatggctcaactt

SEQ ID NO: 10508 - DNA, 206 bp, Artificial Sequence
  Synthetic polynucleotide
cacgcccacaccacccacctgtgcccacagcaaacctctgaggaagagttgtgcaatctgctcaccaacgtgctgttctcggtgacgtggcgtggcgtggcgtggaaggcagcgatgaggctgcctggcgggagcgtggccaggttttctcagtgctcacccagctgggggcctcagccacacttgtgcgcccaccagactgcatc

SEQ ID NO: 10509 - DNA, 204 bp, Artificial Sequence
  Synthetic polynucleotide
gaaagctaaactcacaatcacttctttttcagaaatttggatgaaaactactgccgcaatcctgacggaaaaagggccccatggtgccatacaaccaacaacagccaagtgcggtgggagtactgtaagataccgtcctgtgactcctccccagtatccacggaacaattggctcccacaggtaagcaagggtatgggagctta

SEQ ID NO: 10510 - DNA, 209 bp, Artificial Sequence
  Synthetic polynucleotide
cacgggaggtgagtcccgagctcacggcgtcccccaccgccacagcttaccgcatccacgtgaacttgagcactgtggggattctccgtgctctggactcgtgctctcgggctaccaggtggagctgcgaggccgcacggagctgaaggtgaggcagggccccaacccctcccggaggccccgccctgtcctgaggcaccgcccatccc

SEQ ID NO: 10511 - DNA, 210 bp, Artificial Sequence
  Synthetic polynucleotide
gcagagggcagaggcctagcaactgcccctccccctgcagcagtggtgcgactatcgcctgcgctgggatccgcgagactacgaaggcctgtgggtgctgtgggtgctgagggtgccgtccaccatggtgtggcggccggatatcgtgctggagaacaagtgaggagggggtgcaggcaggggtgtgggggacaaaggacacagggtctg

SEQ ID NO: 10512 - DNA, 214 bp, Artificial Sequence; identical to SEQ ID NO: 9869
  Synthetic polynucleotide

SEQ ID NO: 10513 - DNA, 204 bp, Artificial Sequence
  Synthetic polynucleotide
gtgtggcgaagatggtcaagtcctacctgcagcagcacaacatcccacagcgggaggtggtcgataccactggcctcaaccagtcccacctgtcccaacaacacctcaacaagggcactcccatgaagacgcagaagcgggccgccctgtacacctggtacgtccgcaagcagcgagaggtggcgcagcgtaagtaatgaccct

SEQ ID NO: 10514 - DNA, 208 bp, Artificial Sequence
  Synthetic polynucleotide
ctcgtaaaggaccgcaatgtggccaccccacgagactactactttgctctggcccataccgtgcgcgaccacctcgtggggcgctggatccgcacgcagcacgcagcagcactactatgagaaggaccccaaggtgctgctggggagcctggggtgggggtatgggctgaaggcgctgccagggagctggcgatcttgacttaagtgg

SEQ ID NO: 10515 - DNA, 215 bp, Artificial Sequence
  Synthetic polynucleotide
cactggtgggcgcgggcgccgggggcgcggcggtggctgggctggcagggctgagctggcccggcggcggcgcggcggccccgtggtgcggtggggcaggcggcggtgcggcggtgcggcggccgcgtgcagatggtgtgcgtgcggatgcgggtgggggtgcggcggaggcgggggtgcggccggcgggcctcccaggccattgtacgagttca

SEQ ID NO: 10516 - DNA, 205 bp, Artificial Sequence
  Synthetic polynucleotide
ggctttgggcgccttctggcactgcagctggaccagagaggcttccgagtcctggccagctgcctgaccccctccggggccgaggacctgcagcgggtgggtggcctcctcccgcctccacaccaccctgttggatatcactgatccccagagcgtccagcaggcagccaagtgggtggagatgcacgttaaggaagcaggtaag

SEQ ID NO: 10517 - DNA, 214 bp, Artificial Sequence
  Synthetic polynucleotide
ggccgaggcgcacgcccaggcaaaggcacaggcggagcgggaggcgaaggagctgcagcagcgcatgcaggaggaggtggtgcggcgggaggaggcggcgggaggaggcggcggtggacgcgcagcagcagaagcgcagcattcaggaggagctgcagcagctgcggcagagctcggaggcggagatccaggccaaggcccggcaggcagaggc

SEQ ID NO: 10518 - DNA, 205 bp, Artificial Sequence
  Synthetic polynucleotide
tttggcggacatctcattcttacaggtctgctaggtcctaccatccaggctgaggtttatgatacagtggtcattacacttaagaacatggcttcccatccatcctgtcagtcttcatgctgttggtgtatcctactggaaagcttctgagggtgagtaaaataccctcctattgtcctgtcattctatgaatagaacagtgaga

SEQ ID NO: 10519 - DNA, 220 bp, Artificial Sequence; identical to SEQ ID NO: 9873
  Synthetic polynucleotide

SEQ ID NO: 10520 - DNA, 205 bp, Artificial Sequence
  Synthetic polynucleotide
tcagcttctggggggacagtcggggccgccagtaccaggagctccctcgatgccccgcccccacccccagcctcctcaacatccccctctccagcccgggtgggtcggcggccccggggcgacgtggagagcaggctggatgccctccagcgccagctcaacaggtgagggagtgcaggtggggtgggggggcacgccctggagt

SEQ ID NO: 10521 - DNA, 205 bp, Artificial Sequence
  Synthetic polynucleotide
tctgcttttattttatggttgggataaggctggattattctgagtccaagctaggcccttttgctaatcatgttcatacctcttatcttcctcccacagctagctcctgggcaacgtgctggtctgtgtgctggcccatcactttggcaaagaattcaccccaccagtgcaggctgcctatcagaaagtggtggctggtgtggct

SEQ ID NO: 10522 - DNA, 205 bp, Artificial Sequence
  Synthetic polynucleotide
tcctccgtgcgcaagcgccgagtggtcatcgtggaccccgagacgggcaaggagatgtcagtgtacgaggcctaccgcaagggcctgattgaccaccagacagacgtacctggagctgtccgagcaggagtgcgagtgggaggagatcaccatctcctcctcggacggcgtggtcaagtccatgatcatcgaccgccgctccggg

SEQ ID NO: 10523 - DNA, 209 bp, Artificial Sequence
  Synthetic polynucleotide
ccattgaaactgtgatgctcttctaccctgggctgctcctaacctgtgcccttctctgtccagtcccggcagcagagcccatcgagtatgcccagttccctagttccctttctacctcaacggcttgcgggacacctcagactttgtggaggcaattgaaaaagtaaggaccatctgcagcaactatacgagcctggggctgtccagtt

SEQ ID NO: 10524 - DNA, 204 bp, Artificial Sequence
  Synthetic polynucleotide
agctgggcgtgtggagcggccccgtggtaatctctcttctaccactttttcatgccttgcagcactttgcccatagggaggaaggggaagtgccccagctgctcgctgtacatggcctggctggagaccctgtcccaggacctcagacctccagtcatcctgatccgaggaaaccaggaaaacgtgctcaccttttactgccag

SEQ ID NO: 10525 - DNA, 216 bp, Artificial Sequence; identical to SEQ ID NO: 10010
  Synthetic polynucleotide

SEQ ID NO: 10526 - DNA, 206 bp, Artificial Sequence
  Synthetic polynucleotide
tgctccggggttagcaggtgagcctgcgatgcgcgggaagacgttccgctttgaaatgcagcgggatttggtgagtttcccgctgtctccagcggtgcggtgcgggtgaagctggtgtctgcggggttccagactgctgaggaactcctagaggtgaaaccctccgagcttagcaaaggtaacgactcctgatggcaagctgaggc

SEQ ID NO: 10527 - DNA, 204 bp, Artificial Sequence
  Synthetic polynucleotide
gagtgcatctccgacttcctggacaagcatcagatgaaacacaagaagctgcccctgggcttcaccttctcctttcctgtgaggcacgaagacatcgataataaggtgggccgggtggaggggcagaaggcagatgaggggaggcacaggcaccccagaggaactctgccttcaaatgtagcccccataccatgtgctcagaag

SEQ ID NO: 10528 - DNA, 220 bp, Artificial Sequence
  Synthetic polynucleotide
acctgtcggtggattgtgtgttctgtcctcattgtattgaattgcttgctctctttctcagttaacttaccaagactggttacacctggagctggaaattccacctgaagctggaaattcaacctgaagctgatgctctttcagatactgaacggtaagtgttgaaaagagctaccctggccaggcatgatggctcacacctataatcccagcactttgg

SEQ ID NO: 10529 - DNA, 212 bp, Artificial Sequence; identical to SEQ ID NO: 10230
  Synthetic polynucleotide

SEQ ID NO: 10530 - DNA, 209 bp, Artificial Sequence
  Synthetic polynucleotide
atgtttattttctttcacatccaatgacaaggccttatctctgtctcacctcacagcccccacctctgctcccaaggacttgacagtcattactagggaagggaagggaagcctcgtgccgtcattgtgagttggcagcctcccttggaagccaatgggaaaattactggtaagcatctccactttctctcccagcatagctctccctt

SEQ ID NO: 10531 - DNA, 207 bp, Artificial Sequence
  Synthetic polynucleotide
gctgcggagagggggagagcaggcagcgggcggcggggagcagcatggagccggcggcggggagcagcatggagccttcggctgactggctggccacggccacggccgcggcccggggtcgggtagaggaggtgcgggcgctgctggaggcgggggcgctgcccaacgcaccgaatagttacggtcggaggccgatccaggtgggta

SEQ ID NO: 10532 - DNA, 211 bp, Artificial Sequence; identical to SEQ ID NO: 10288
  Synthetic polynucleotide

SEQ ID NO: 10533 - DNA, 209 bp, Artificial Sequence
  Synthetic polynucleotide
gggtgggggcgggtggcagggcctcttcctcactcatttcattgtcatctgcattcccccagggcttcagtttccacctggctgcggtcctgctgtccctaggaccctggcttttatcacttacgtggagcatggtgagtgcagggcccagcccagccgttggatagaaggttggtgggggggctggagacagcctcccctgaggctaa

SEQ ID NO: 10534 - DNA, 217 bp, Artificial Sequence; identical to SEQ ID NO: 9988
  Synthetic polynucleotide

SEQ ID NO: 10535 - DNA, 208 bp, Artificial Sequence
  Synthetic polynucleotide
ggggagcctgggtctcaccctataccacccgcatgcagatcatggacgagatcaaggaaggcatccagtacgtgttccagaccaggaacccactcacacttcacactggtcatctctggctcgggacactgtgccctggaggccgccctggtcaatgtgctggagcctggggactccttcctggttggggccaatggcatttgggggc

SEQ ID NO: 10536 - DNA, 209 bp, Artificial Sequence
  Synthetic polynucleotide
tgcggagatgagcgggtccctcggccgagctgcggcggctctgctccgctgggggcgcggcgcgggcggcggtggcctttggggtccgggcgtgcgggcgtgcgggcggcgggctcgggcgcgggcggcggcggctcggcggagcagttggacgcgctggtgaagaaggacaaggtggtggtcttcctcaaggggacgccggagcagcc

SEQ ID NO: 10537 - DNA, 205 bp, Artificial Sequence
  Synthetic polynucleotide
tatttttctttgtcagctcgttttgacaggagccattcaagtagcagacaaagtttcttcagggaagagttcagtgcttgtgcattgcagtgacggatggatgggacaggactgctcagctgacatccttggccatgctgatgttggatagcttctataggagcattgaagggttcgaaatactggtacaaaaagaatggataag

SEQ ID NO: 10538 - DNA, 213 bp, Artificial Sequence
  Synthetic polynucleotide
ccccagcttttaggaaagccatggtcccttgggcagtatacctcctctctccatggcctctttgttcataacgagggtgtattcataaatgcccccaagcacagcccacagcctctgtgatgtagtgggtcccaaaatcacggaagagatctctgtattccccgtagctgtactccaggggcagccgcttaactctctgaaggaactcgtaat

SEQ ID NO: 10539 - DNA, 210 bp, Artificial Sequence
  Synthetic polynucleotide
gccttgtgtcgcagacggtgaccagtgcttggtcttgcccttggagcacccgtgcgccagcctgtgctgcgggcacggcacgtgcatcgacggcatcggcggcatcggcagcttcagctgcgactgccgcagcggctgggagggccgcttctgccagcgcggtgagggggagaggtggatgctggcgggcggcggggcggggctggggcc

SEQ ID NO: 10540 - DNA, 208 bp, Artificial Sequence
  Synthetic polynucleotide
gacgtgacggcgtccgcgcttcagggtctgcacatcgcggtccacgagtgtcagcaccagctgcgcgaccagcgctggaactgctccgcgcttgagggcggagggcggcggccgcctgccgcaccacagcgccatcctcaagcgcggtgagcctggctgggcgggtcggcgctgccgcggaggctagggggtgggcggcagggcgagg

SEQ ID NO: 10541 - DNA, 208 bp, Artificial Sequence; identical to SEQ ID NO: 10422
  Synthetic polynucleotide

SEQ ID NO: 10542 - DNA, 208 bp, Artificial Sequence
  Synthetic polynucleotide
tgtccaggtaggccccaacagtttctcttgtctggcaggtcttctattactccacgagcatcttcgagaaggcgggggtgcagcagcctgtgtatgccaccggataccattggctccggtatcgtcaacacggccttcactgtcgtgtcggtgagtctttgcttactggcccccccagccaaaccccagggaggaggcagtgccatct

SEQ ID NO: 10543 - DNA, 205 bp, Artificial Sequence
  Synthetic polynucleotide
tttcttaggaagttatccctatgcacctggccacctcccccatcctgtcagaaggagcttcgagaatggaatgccagctgaaaaggggctctgtggacagacaggatgagaggcctggaccccagcacgccagcccaagtgatcgctcccagcgagacgccgtcaagcagctctgtagtaaagaagagaagaaaaaggaggagaa

SEQ ID NO: 10544 - DNA, 204 bp, Artificial Sequence
  Synthetic polynucleotide
ggcaatttttctttccgagtttatgatttcccaagaataaattaccatgtgccattcatccttcatcccacgcaggctccatcgaagactggtgcccaccacctacgagagcgcgtccatccgccgattccaggagggacgcgtggacaacatcagatcggccactccagaggcactggcttttgtgagagccgtgactgacca

SEQ ID NO: 10545 - DNA, 223 bp, Artificial Sequence
  Synthetic polynucleotide
ccaaggggacagtagcccctgctcggccttcgagttccactgcctaagtggcgagtgcatccactccagctggcgctgtgatggtggccccgactgcaaggacaaatctgaggacaaatctgacgaggaaaactgcggtatgggcggggccagggtgggggcggggcgtcctatcacctgtccctgggctcccccaggtgtgggacatgcagtgatttaggtg

SEQ ID NO: 10546 - DNA, 217 bp, Artificial Sequence; identical to SEQ ID NO: 9926
  Synthetic polynucleotide

SEQ ID NO: 10547 - DNA, 209 bp, Artificial Sequence
  Synthetic polynucleotide
ccgggcctcaagagagtgggtgtctccggaggccatgggctacccggaggtggagcgcagggaactcctgcctgcagcagcgccgcgggagcgagggagcgagggagccagggctgcgggtgtggcggggcccctgcccgggcgggcgaagggaacagctgcctgctcttcctgggtttctttggcctctcgctggccctccacctgct

SEQ ID NO: 10548 - DNA, 215 bp, Artificial Sequence; identical to SEQ ID NO: 10042
  Synthetic polynucleotide

SEQ ID NO: 10549 - DNA, 227 bp, Artificial Sequence; identical to SEQ ID NO: 9909
  Synthetic polynucleotide

SEQ ID NO: 10550 - DNA, 214 bp, Artificial Sequence
  Synthetic polynucleotide
acccccactgagaggggaggccaggctgcccccagctcccccattcaggctctcaactgaaggccaagccccccaagaagccggagagcagcgcagagcaccagcgcagagcagcagcgccttccactcgggaacggtgagcggggcccagtgggagcgcctcccttctccctggccaggggcaaggggtcaggggtcagagcagggcctgccc

SEQ ID NO: 10551 - DNA, 205 bp, Artificial Sequence
  Synthetic polynucleotide
atccacccaggtcatggtgatcaaacgccccggcaggaagcgaaaagctgaggccgaccctcaggccattcccaagaaacggggccgaaagccggggagtgagtgtggtggcagccgctgccgccgaggccaaaaagaaagccgtgaaggagtcttctatccgatctgtgcaggagaccgtactccccatcaagaagcgcaagac

SEQ ID NO: 10552 - DNA, 209 bp, Artificial Sequence
  Synthetic polynucleotide
ttccagccgcgggccttccacgcgctctgcctgggcagcggcgggctccgcttggcgctgggccttctgcagctgctgcccggccgccggcccgcgggcccgcgggccccgggtcccccgcgacgtccccgccggcctcggtccgcatcctgcgcgctgccgctgcctgcgaccttctcggctgcctgggtaagggcgcgcgcggcccg

SEQ ID NO: 10553 - DNA, 207 bp, Artificial Sequence
  Synthetic polynucleotide
tgctggaagccttcaaaaacattacttccagttccccggaaagacatatttttggagaggacagagttgtctctgagcagcctcaagtgggcacacttgaagaaagaaaggaatgacgtcgtggaagcactgacaggcagtgcagcctcgaggctccgcgggggcacttcctccagacgcctctcttccacaccccttccaaaagca

SEQ ID NO: 10554 - DNA, 207 bp, Artificial Sequence
  Synthetic polynucleotide
agatgtgtccattctccatgtcttcatcagacctcactctgcttgtactccctccctcccaggtgcccgcccctgcatccctaaaagcttcggctacagctacagctcggtggtgtgtgtctgcaatgccacatactgtgactcctttgaccccccgacctttcctgcccttggtaccttcagccgctatgagagtacacgcagtgg

SEQ ID NO: 10555 - DNA, 210 bp, Artificial Sequence
  Synthetic polynucleotide
aacagatatgctgtttcattatttgctggttaattccttggtttaatttcctcttttagggtgaaattggagctgttggtaacgctggtcctgctggtcctgctggtcccgccggtccccgtggtgaagtgggtcttccaggcctctccggccccgttggacctcctgtaagtagccactgtctttaaactttattgagtaaaagaaaac

SEQ ID NO: 10556 - DNA, 219 bp, Artificial Sequence
  Synthetic polynucleotide
cagatggtggccgcgctgaagtctcagccggcccagccagtgaacgtggggctggtggactggatcaccctggcccacgaccactacaccatcgccgtccactacaccgtcgccgtccgcaacacccgccttgtgggcaaggaggtcgcggctcttctccggtggctggaggtaccgacctgccccatccttccttcacctcccttccctcctttccct

SEQ ID NO: 10557 - DNA, 205 bp, Artificial Sequence
  Synthetic polynucleotide
gaaggcacagattcgggccaatggcttcaagctggagacagggcccccgatgggggtgcccccgccgccccctcccgcaccggactacgtgctgcctcccacccagcctgcatgggcctgagcccaagggcctggccgccggtccacctgctgggccactgggcgactttggggccccagcactgcccatggccgtgcccggtgc

SEQ ID NO: 10558 - DNA, 212 bp, Artificial Sequence; identical to SEQ ID NO: 10312
  Synthetic polynucleotide

SEQ ID NO: 10559 - DNA, 206 bp, Artificial Sequence
  Synthetic polynucleotide
gggcacacctttcccaccctgctcaggcaatgtccctttctcctttcagtcgggaggcaagatcagctcggcgctgcatttctgccgggccgtgtgccgccccgccgggccgagagacggtaagagggctggagagagggagagggcccaagggagagggagaggaacaagggggaggggggagggagagggagaggaggacggag

SEQ ID NO: 10560 - DNA, 206 bp, Artificial Sequence
  Synthetic polynucleotide
tcggggccgccagtaccaggagctccctcgatgccccgcccccacccccagcctcctcaacatccccctctccagcccgggtcggcggccccggggcgacgcgacgtggagagcaggctggatgccctccagcgccagctcaacaggtgagggagtgcaggtggggtgggggggcacgccctggagtctggtccaggtcctggcgg

SEQ ID NO: 10561 - DNA, 204 bp, Artificial Sequence
  Synthetic polynucleotide
ctggggggacagtcggggccgccagtaccaggagctccctcgatgccccgcccccacccccagcctcctcaacatccccctctccagcccgggtcggcggcggccccggggcgacgtggagagcaggctggatgccctccagcgccagctcaacaggtgagggagtgcaggtggggtgggggggcacgccctggagtctggtcc

SEQ ID NO: 10562 - DNA, 218 bp, Artificial Sequence; identical to SEQ ID NO: 10008
  Synthetic polynucleotide

SEQ ID NO: 10563 - DNA, 205 bp, Artificial Sequence
  Synthetic polynucleotide
tgaggagtatgtcgcctgcctccctgacaacagctcaggcaccgtggcagcagtgtccttttcagctgcccacgaaggcctgcttcagccagaggcctgcatgcagcgccttctgcttctccaccggccagggcctcgcagccctctcggagcagggctggtgcctgtgtggggcggcccagccctccagtgcctcctttgcctg

SEQ ID NO: 10564 - DNA, 204 bp, Artificial Sequence
  Synthetic polynucleotide
acgcagtgctcccccggcccaggcttcctgaactactacgatgcctgctcggagggtctgcgcgccgccagccccgccctgcggctgggaggccccggcggcgactccttccacaccccaccgcgatccccgctgagctggggcctcctgcgccactgccacgacggtaccaacttcttcactggggaggcgggcgtgcggctg

SEQ ID NO: 10565 - DNA, 205 bp, Artificial Sequence
  Synthetic polynucleotide
ccctgagcaatggcggctgccagtatctgtgcctccctgccccgcagatcaacccccactcgcccaagtttacctgcgcctgcccggacggcatgctgcttgctggccagggacatgaggagctgcctcacaggtgtggcacacgccttgtttctgcgtcctgtgtcctccaactgccccctcctgagcctctctctgctcatct

SEQ ID NO: 10566 - DNA, 209 bp, Artificial Sequence
  Synthetic polynucleotide
gcttcatcttcactgagttcctggagccggcagccaatgagaccgtgcggcacgggtgtctgcgcctcaaccagcccacccacgtcaacaacggcaactaggcaactacacgctgctggctgccaaccccttcggccaggcctccgcctccatcatggctgccttcatggacaaccctttcgagttcaaccccgaggaccccatccctg

SEQ ID NO: 10567 - DNA, 206 bp, Artificial Sequence
  Synthetic polynucleotide
atgagaaaactactatgacttctaaattacgaaaaaatgttaaaaagtcataatgtttttcttttcaggacatgtgaacttatatatttgacacaacccaacccagcagttcgtaagtagttcacagaatgttatttttcacttaaaaaaaaagatttttatggaataatctcaaacatcttgatagttagggttagtttgatcga

SEQ ID NO: 10568 - DNA, 205 bp, Artificial Sequence
  Synthetic polynucleotide
gatatattttcacctttccctcccactggcagaaaaccctactcagtcaccatggtgttcacagtatcgcagacagctactgaagtccctaccagagttagttaagtgcctctgcagagttgtgtatagaagacagaccaatgcctaagttggaaattgagaaggaaattgaattaggtaagtaccattgaactcatgtcctctg

SEQ ID NO: 10569 - DNA, 210 bp, Artificial Sequence
  Synthetic polynucleotide
cgcgctgcgcggcctggccaacctgacgcacgcgcacctggagcgcggccgcatcgaggcggtggcctccagctcgctgcagggcctgcgccgcctgcgccgcctgcgctcgctcagcctgcaggccaaccgcgtccgtgccgtgcacgctggcgccttcggggactgtggcgtcctggagcatctgctgctcaacgacaacctgctggc

SEQ ID NO: 10570 - DNA, 204 bp, Artificial Sequence
  Synthetic polynucleotide
ttcctccttcctcttccctcctccctctgcagtttcttagcgaggttgggctgttcatcatgtctggactatttcacgacccaggggctgaccaccatcttctatcagattgagcattactccatggatgtaagtaactgttagacttttctcaaattttatttcttcatttctttcctctgatgacaaccgccttgtagttca

SEQ ID NO: 10571 - DNA, 207 bp, Artificial Sequence
  Synthetic polynucleotide
accctaatgtaaaagtccccctgcgagtttccagcacggatctgaaaggcattgtaggcaccggggtagacggaggtcgcctggatctggaacacgtcagcgggcgggcacgctccgctccgaggtgatggtcatgtagcggtgcacaatggatgaaggctgctctcgacatagagggttggaggccgggcagagacagcggctaga

SEQ ID NO: 10572 - DNA, 206 bp, Artificial Sequence
  Synthetic polynucleotide
tcttgtgggtgtaaacggctttcaaccccaacctgtccagaggcctctggatcagtttgtgctgcagtcgcacgcatggttcaacgtgtcctccctcccctcccctatgcggtgcccccgctcagcctgccccgaggggaagctcaggtgagtgtggggggatggagcagagaccagtcctgcaggacccattgtcccccagtcag

SEQ ID NO: 10573 - DNA, 216 bp, Artificial Sequence
  Synthetic polynucleotide
tagcccctgctcggccttcgagttccactgcctaagtggcgagtgcatccactccagctggcgctgtgatggtggccccgactgcaaggacaaatctgacaaggacaaatctgacgaggaaaactgcggtatgggcggggccagggtgggggcggggcgtcctatcacctgtccctgggctcccccaggtgtgggacatgcagtgatttaggtgcc

SEQ ID NO: 10574 - DNA, 217 bp, Artificial Sequence
  Synthetic polynucleotide
cgaggcctcctgcccggtgctcacctgtggtcccgccagcttccagtgcaacagctccacctgcatcccccagctgtgggcctgcgacaacgaccccgactgcgaagactgcgaagatggctcggatgagtggccgcagcgctgtaggggtctttacgtgttccaaggggacagtagcccctgctcggccttcgagttccactgcctaagtggcgag

SEQ ID NO: 10575 - DNA, 204 bp, Artificial Sequence
  Synthetic polynucleotide
gggggagtccctggagggcccgggccgcgctgacctcgcgtccctccgcaggagattccccggagcacgctggactcgttcatgcagccgttccagagcagcacactgtggctgctggtggggctgtcggtgcacgtggtggccgtgatgctgtacctgctggaccgcttcaggtgagcgcgacccggggctcagacacctcca

SEQ ID NO: 10576 - DNA, 205 bp, Artificial Sequence
  Synthetic polynucleotide
cccacaggccctccagtgggtccgctctccctggggctggcgacagtggacatccagaaccctgacatcacgagttcacgataccgtgggctcccagcacgcacctggacctagcccagctgataagaaacgctcagggaagaagaagatcagcaaagctgatattggtgcacccagtggattcaagtgagagccactccccagt

SEQ ID NO: 10577 - DNA, 204 bp, Artificial Sequence
  Synthetic polynucleotide
cttctgcaatcgcagtccgcgcgtcgtgctgcccgtatggctcaacttcgacggcgagccgcagccctacccaacgctgccgcctggcacgggccgccgccgcatccacagctaccgaggtacgggcccggcgcttaggcccgacccagcagggacgatagcacggtctgaagcccctctaccgccccggggtccattttgcag

SEQ ID NO: 10578 - DNA, 211 bp, Artificial Sequence
  Synthetic polynucleotide
gaacccgccctgcactgctgtctgggcgggtccggggactcagcactcgacccaaaggtgcaggcgcgcgagcacaacccatggctgcgctgggctgcgctgggctgcgcgaggctgaggtgggcgctgcgaggggccggccgtggcctctgcccccacggggccagagccaaggccgcgatccctgccgccctcccctcggacaaggcca

SEQ ID NO: 10579 - DNA, 209 bp, Artificial Sequence
  Synthetic polynucleotide
gcacgcgtgcctgcctggcagcccctcacccaggtgctccctgcaggtcctgcctgactacctgaagggactcttcagcagtgtgccggccagccggcccgccggcccagcgagcagctgctgcagcaggtgtccaagctggcttcactgcagcatcgcgccaaggaccacttctacctgccgagcgtgtgagcatctgccctcctgcc

SEQ ID NO: 10580 - DNA, 209 bp, Artificial Sequence
  Synthetic polynucleotide
cactctggctcccaccttttcggcttcccacccacgccacccaaagaagtgtctcctgaccctagcaccacgggggctgcgtctccagcctcatcttccgctcttccgcggggggtagtgcagcccgaggagaggacaaggacggcgtcaagtaccaggtgtcactgacggagagcatgaagatggaaagtggcagtcccctgcgccca

SEQ ID NO: 10581 - DNA, 212 bp, Artificial Sequence
  Synthetic polynucleotide
tggactgcaccatgggccgctgtgcctgggagagcctgctcccttttggaggggcgtcctgagcaccccagactcctggcttccccctggcttcccccaggcttcccccagggccccaaggacatgctcccacttgtggagggcgagggcccccagaatggggagaggaaggtcaactggctgggcagcaaagagggactgcgctggaagga

SEQ ID NO: 10582 - DNA, 209 bp, Artificial Sequence; identical to SEQ ID NO: 10552
  Synthetic polynucleotide

SEQ ID NO: 10583 - DNA, 206 bp, Artificial Sequence
  Synthetic polynucleotide
tctgagccgcagcaaatgggctccgacgtgcgggacctgaacgcgctgctgcccgccgtcccctccctgggtggcggcggcggctgtgccctgcctgtgaggggagcggcgcggcgcagtgggcgccggtgctggactttgcgcccccgggcgcttcggcttacgggtcgttgggcggccccgcgccgccaccggctccgccgcca

SEQ ID NO: 10584 - DNA, 205 bp, Artificial Sequence
  Synthetic polynucleotide
aacaatacagggatgaatcaaaatttaggccttacaaataatactccaatgaatcagtccgtaccaagataccccaatgctgtaggattcccatcaaacaaacagtggtcaaggactaatgcaccagcagcccatccaccccagtggctcacttaaccaaatgaacacacaaactatgcatccttcacagcctcagggaacttat

SEQ ID NO: 10585 - DNA, 212 bp, Artificial Sequence
  Synthetic polynucleotide
agtggtgaagcccctgctggtgtccaccctcggtgagaagagcgggaaaggactgaagacctgtaagagccctgggcggaaaagcaaggagagcagccccagggtggccccaaggggcgcagcagcagcgcctcctcaccccccaagaaggagcaccaccaccatcaccaccactcagagtccccaaaggcccccgtgccactgctcccacc

SEQ ID NO: 10586 - DNA, 208 bp, Artificial Sequence; identical to SEQ ID NO: 10422
  Synthetic polynucleotide

SEQ ID NO: 10587 - DNA, 204 bp, Artificial Sequence
  Synthetic polynucleotide
ggaatccccaagtagttagtgttgcattgtctgctgccgtccagagcccagaacgcttcctccagcttggcgccaaggtcccaaagggcgcactgctgctgctcggcccccccggctgtgggaagacgctgctggccaaggcggtggccacggaggctcaggtgcccttcctggcgatggccggcccagagttcgtggaggtca

SEQ ID NO: 10588 - DNA, 204 bp, Artificial Sequence
  Synthetic polynucleotide
tgtgcagccacaaagcagagcctcagatgctagcttccgcctctgtctctagggtccagaaggccctgtcctgacgcctcctctcctcgcaggagtctgatgactggaaggtgctgaagctggttctgggcaggctgcctgagtccctgcgctataaagtgctcatctttacttccccttgcagtgtggaccagctgtgctctg

SEQ ID NO: 10589 - DNA, 204 bp, Artificial Sequence
  Synthetic polynucleotide
tcaaataggatcatggacttcttggaggagccaatccctggtgtagggacctatgatgatttcaatacaattgattgggtgagagagaagtctcgagaccaccgggataggcaccgagaggtaagacaaaagatggcacatgggtaagtgttaggaaatacaggggaagaaattgaagatacatattctttctattctttcctt

SEQ ID NO: 10590 - DNA, 211 bp, Artificial Sequence
  Synthetic polynucleotide
gtgtggagaggagatgggaaagttgcgggggacctgggaggcggctgaccccaaggtatgtgcaggactgccaagcggggctgaactttgcagacgaggacgaggacgaggcccaggccttccgggccctcgtgcaggagaagatacaaaaaaggaatcagaggcaaagtggaggtgaggaggccacaggggaggaaaggaagttgggcag

SEQ ID NO: 10591 - DNA, 205 bp, Artificial Sequence
  Synthetic polynucleotide
ggacacagctgggaagccagttgggggttgggggagtgccccaggcagggcccacccgtctccctgggctaactcccctgcctcacccatacccccacagtagtaccctggcgtggcccagagcatcaacagtgatgtcaacaacctcatggccgtgttgaacatgagcaacatgcttccagaaggtctgaggctaggtggttgg

SEQ ID NO: 10592 - DNA, 209 bp, Artificial Sequence
  Synthetic polynucleotide
ctccagtctcaacagcctgaataacttgaacaacctgagtagcccgtcgctgaattccgcggtgccgacgcctgcctgtccttacgcgccgccgactcctcgactcctccgtatgtttatagggacacgtgtaactcgagcctggccagcctgagactgaaagcaaagcagcactccagcttcggctacgccagcgtgcagaacccggc

SEQ ID NO: 10593 - DNA, 210 bp, Artificial Sequence
  Synthetic polynucleotide
cggcgggggcgacggcgcgggttgtggcggccgcaggccgggccctgcgaggcctcagctaccgcagcctgcggcggcgcgtgcggcggctgcggcggctgcggcggcttacggcccgcgaggcggccaccgcagtggcggcgctgctctgggcagcagtgacgcgcgctggggccgctggcgcgggggcggcggcgggcgcgctgggcc

SEQ ID NO: 10594 - DNA, 209 bp, Artificial Sequence
  Synthetic polynucleotide
aacaacggcggctgttcccacgtctgcaatgaccttaagatcggctacgagtgcctgtgccccgacggcttccagctggtggcccagcgaagatgcgaagatgcgaaggtgatttccgggtgggactgagccctgggccccctctgcgcttcctgacatggcaaccaaacccctcatgcctcagtttccccatctgttaagtgtgcttg

SEQ ID NO: 10595 - DNA, 207 bp, Artificial Sequence
  Synthetic polynucleotide
tccatcatgtatgcgacaaggaggctaaccccatgctcttgttccctcaggtaccctcacatccatcaccaacctcgccacaagcctggcccggaacatggacggaccggctctcactggatgaggagcactacaaccggcaggaggagtggcggcggcagctccccgagagcctgggcgaggggcttcgacagggcctgtcccggc

SEQ ID NO: 10596 - DNA, 206 bp, Artificial Sequence
  Synthetic polynucleotide
cagctgaccgttaaaagacaaggactctattatatctatgcccaagtcaccttctgttccaatcgggaagcttcgagtcaagctccatttatagccagcccagcctctgcctaaagtcccccggtagattcgagagaatcttactcagagctgcaaatacccacagttccgccaaaccttgcgggcaacaatccattcacttggga

SEQ ID NO: 10597 - DNA, 221 bp, Artificial Sequence
  Synthetic polynucleotide
cccagatcttcaggtttctgcgatgcagcaccagacagtgctggaactgacagagactggggtggaggcggctgcagcctccgccatctctgtggcccgcccgccatctctgtggcccgcaccctgctggtctttgaagtgcagcagcccttcctcttcgtgctctgggaccagcagcacaagttccctgtcttcatggggcgagtatatgaccccagggc

SEQ ID NO: 10598 - DNA, 212 bp, Artificial Sequence
  Synthetic polynucleotide
cgcgggggacgcaagcggcgcagcagcaggcgcagcgcgggcggcggcgcggggcccggcggagccgcgggtgggggcgtcggaggcggcgacgagccggggacgagccgggcagcccggcccagggcaagcgcggcaagaagtctgcgggctgtggcggcggcggcggcgcgggcggcggcggcggcagcagcagcggcggcgggagtccg

SEQ ID NO: 10599 - DNA, 207 bp, Artificial Sequence
  Synthetic polynucleotide
tctccatcccctgctgcgggggaccgcgcaagcgcagtgagtactgcacgttgtcgcgggccagtaacgtcatcagacgtgtgtgtgtccctgcggcgctaagtaagaaggggagactgaggctgaggctggggaacatcgggcagcatgagcggctgcgggctcttcctgcgcaccacggctgcggctcgtgcctgccggggtctg

SEQ ID NO: 10600 - DNA, 206 bp, Artificial Sequence
  Synthetic polynucleotide
gggaagagctgtggcctccgcaacctcctactcacttccgctccgttctcttgcccgccctgcagcggcacccgacctgacagcgttcagcgacccgcgccgcgccagttccccgcgctgccctccatctccgacccccgcatgcactatccaggcgccttcacctactccccgacgccggtcacctcgggcatcggcatcggcat

SEQ ID NO: 10601 - DNA, 206 bp, Artificial Sequence
  Synthetic polynucleotide
cccactcctaggtttctggtgagcttcatggttgacgcccggggtggttccatgagaggaagtcgccacaacggcctgcgagtggtgatcccgccacggaccggacgtgcgcagcgcccacccgcatcacctgccgcctggtcaagccccagaagctcagcacgccgcccccactggccgaggaggagggcctggccagcaggatc

SEQ ID NO: 10602 - DNA, 205 bp, Artificial Sequence
  Synthetic polynucleotide
ggtcctgaccttggctggggggcaccccctgggtgtaagtggtggttttcttgagcgtgtactggcgcccgcaggcctcatcctcctccatgatgcccttgctgctgctgacggagggcacgcaggtgttggcgcccgagtggatacccgagtcgtaggtgtatgtctgctgccactcagtcaccttgataggctgctccatcag

SEQ ID NO: 10603 - DNA, 211 bp, Artificial Sequence
  Synthetic polynucleotide
aggtccctgtcccccggcccccacaccggctcccccaacgccaggagaaaagccattgcctccagggatggggatgaagcctgtccctcctgggccatagccattgccattgccattgccacttggggcaaagccatttcccccagtgcctccaggtctggaaccagcactccctggaattcctcccattggaagtccatccatgcaaagt

SEQ ID NO: 10604 - DNA, 216 bp, Artificial Sequence
  Synthetic polynucleotide
gtgtcttccaggcatgggcatccagtggcgagacctcctgagtcccgtcaacgtggacgacgacttctgcttcgggcaggtgctggggatgctgctgctggggatgctgctgctggactctgtgctctatggcctggtgacctggtacatggaggccgtcttcccagggcagttcggcgtgcctcagccctggtacttcttcatcatggtgagttc

SEQ ID NO: 10605 - DNA, 209 bp, Artificial Sequence
  Synthetic polynucleotide
gaaaagggccccagagggttcccgcctcaaaacctcggaggcaccgtgctgaggagggccgcgggcgggtccactggcccagcgccgcctcacttcctgggcccggcccggcccagcccacgtcaccaaagggaccctcgccggtggccgagcgtggcgggggcccgcacggggtacagaggtcggagtcggtgtctgactctccctcc

SEQ ID NO: 10606 - DNA, 217 bp, Artificial Sequence
  Synthetic polynucleotide
gagccagcgaacccagcgaggaagtgaacaaggcctctggccccagggcctgtccccccagccaccacaccaagctgaagaagacatggctcacacggcacatggctcacacggcactcggagcagtttgaatgtccacgcggctgccctgaggtcgaggagaggccggttgctcggctccgggccctcaaaagggcaggcagccccgaggtccagg

SEQ ID NO: 10607 - DNA, 204 bp, Artificial Sequence
  Synthetic polynucleotide
tacggtagagacccgcggcaccgcgcgcggcttccagcctcccgaaggtggcttcggctgggtggtggtgttcgctgccacctggtgcaacggctccatcatcttcggcatccataactctgtcgggatcctctactccatgctgctagaggaggaaaaggaaaaaaatcgccaagtggagttccaagcaggtgagtggccccg

SEQ ID NO: 10608 - DNA, 201 bp, Artificial Sequence
  Synthetic polynucleotide
tccgcccccgtagccgccgccggagcttccgccgccggagcttccgcctccgtagccgccgccggaactgccgccgtggccgccgccgtggccgccgccgggagcttccgccgccggagcttccgccgccgtagccgccgccgaaacttccgccgccgcgtccgccgcctccggaactaaacggggtgaggtcacattcgg

SEQ ID NO: 10609 - DNA, 208 bp, Artificial Sequence
  Synthetic polynucleotide
gtgataaggtctatgcccaccagatggttcgtacagattcccgggaacagaagcttgatgcatttctgcagcctctgagcaaacccctgtccagtcagccgtcagccccaggccattgtcacagaggataagacagatatttctagtggcagggctaggcagcaagatgaggagatgcttgaactcccagcccctgctgaagtggctg

SEQ ID NO: 10610 - DNA, 212 bp, Artificial Sequence; identical to SEQ ID NO: 10414
  Synthetic polynucleotide

SEQ ID NO: 10611 - DNA, 211 bp, Artificial Sequence
  Synthetic polynucleotide
tccccatcccctcctcacttctgcctcacagtggccaggtcctgtgccagattgtccctctcaacctccagccgggcgctgttggcggtgagttgatcgagccgcagccgcagccgcagctctcgcagctcagcctggtagacgtctgccagcttggtgggctccttggcccgcagctggttcagctcagcagccagcgccttgttttgct

SEQ ID NO: 10612 - DNA, 221 bp, Artificial Sequence
  Synthetic polynucleotide
cgagctcgggctgccgggcacaagcgaactgcaggcccggcgcactggtgggcgcgggcgccgggggcgcggcggtggctgggctggcagggctgagctggcccggcggcggcccggcggcggcgcggcggccccgtggtgcggtggggcaggcggcggtgcggcggccgcgtgcagatggtgtgcgtgcggatgcgggtgggggtgcggcggaggcgggg

SEQ ID NO: 10613 - DNA, 206 bp, Artificial Sequence
  Synthetic polynucleotide
attttggttccagaccaacatgatcccgggctcccccggcagtacggagttagagggtggcttcagtcggcaacgcaagcgcaagttgtccttccgcaggccaggcgcacggacaagggtgaggcgggggaggggaggaagggggagggcggggacaaggtgaggctgggagctggaaggcggggtgggccgtgtctgctttaccc

SEQ ID NO: 10614 - DNA, 205 bp, Artificial Sequence
  Synthetic polynucleotide
tgcacaacaaggagctcatggcctccctggcagaaagcagctttgatgtcatgctgacggaccctttccttccttgcagccccatcgtggcccagtacctacctgtctctgcccactgtattcttcttgcatgcactgccatgcagcctggaatttgaggctacccagtgccccaacccattctcctacgtgcccaggcctctct

SEQ ID NO: 10615 - DNA, 207 bp, Artificial Sequence
  Synthetic polynucleotide
caaggcccagttagacgcagctgtgaccttcggccccagccaggtggcccggggcgaggaccccgccctgcagatctgctgtcatcctggctgcaccccccccccccgcccagcttgctgccattgcccagatccccatgcctgagggcccctcggctggcctgggcatgtgatggctcctcactgggagcctgtgggggaggctca

SEQ ID NO: 10616 - DNA, 205 bp, Artificial Sequence
  Synthetic polynucleotide
agctgcacgcgggcagccggcgagcgacacagacggcctggacagcgtagaggccgccgcgccgccacccatcctcagcagctcggtggagtggagcactcacttcgggcgagcgctcggccagtgcccgtttccccgccaccggcccgggctccagcgatgacgaggacgacgacgaggacgagcacggtggcgtcttctccca

SEQ ID NO: 10617 - DNA, 212 bp, Artificial Sequence; identical to SEQ ID NO: 9960
  Synthetic polynucleotide

SEQ ID NO: 10618 - DNA, 204 bp, Artificial Sequence
  Synthetic polynucleotide
gtctgcctcctcaaggcccggcagaagatcgccgtcaagatggtgcacgctgacatctccatcaacatgagcaagcacaccacgttctttggggccatcatcaggctgggtgaagcccctgcatcctagattccccccattttgcctctgtccgtgccccttccctgggtttgggagccaggactcccagaacctctaagtgct

SEQ ID NO: 10619 - DNA, 206 bp, Artificial Sequence
  Synthetic polynucleotide
ttgtatgatattagaattcaggtgcggggcctccccagtttgggcgggactcacactcttttgcccaatagggtgatgttgggagtgcaggactaaagggtagggtgacaaggtgagtgtgggcatggggagggcagggcaggggccagggtgctcccgactcctctgattcctgcctgccccctcagggagactcagctgtgatc

SEQ ID NO: 10620 - DNA, 204 bp, Artificial Sequence
  Synthetic polynucleotide
agtagcaggttttcttttcaggcaagaagacgtcccgtcaccccctgcaccaggacctgcactatttccccttcaggcccagcgatctcatcgtttgcgccgcctggacggcgatggagcacatcagccggaacaacggctgtctggttgtgctcccaggcacacacaagggctccctgaagccccacgattaccccaagtggg

SEQ ID NO: 10621 - DNA, 205 bp, Artificial Sequence
  Synthetic polynucleotide
gcaagagaaggggaggcggggtaagggaagtaggtggaagattcagccaagctcaaggatggaagtgcagttagggctgggaagggtctaccctcggccggccgccgtccaagacctaccgaggagctttccagaatctgttccagagcgtgcgcgaagtgatccagaacccgggccccaggcacccagaggccgcgagcgcagc

SEQ ID NO: 10622 - DNA, 217 bp, Artificial Sequence
  Synthetic polynucleotide
cagccccctgtgaccctgcttgtctgccacctgcagatgtggccgaggaggcgggctgccccctgtcctgtgcagtcagcaagagacggctggagtgtgaggagtgtgaggagtgtggcggcctgggctccccaacaggcaggtgtgagtggaggcaaggagatggcaaaggtaagccctggaaacgcccaagggaggcctgcaggggcgatggcac

SEQ ID NO: 10623 - DNA, 205 bp, Artificial Sequence
  Synthetic polynucleotide
agtgacaggcctcacccccacaggcctggctgtgatgcactcacagggcagcgattacctggacatcggcaacaacccgagagtgggcaccaagcggtacgtacatggcacccgaggtgctggacgagcagatccgcacggactgctttgagtcctacaagtggactgacatctgggcctttggcctggtgctgtgggagattgc

SEQ ID NO: 10624 - DNA, 208 bp, Artificial Sequence
  Synthetic polynucleotide
ctgtggccctgagcaatggcctggtgctggcggccctagctcggcggggccggcggggccactgggcacccatacacgtcttcattggccacttgtgccttgtgcctggccgacctggccgtggctctgttccaagtgctgccccagctggcctggaaggccaccgaccgcttccgtgggccagatgccctgtgtcgggccgtgaagt

SEQ ID NO: 10625 - DNA, 205 bp, Artificial Sequence
  Synthetic polynucleotide
cacagagtttgctagccctggagctgcctccatccctgttcccaggcccagagaaatcccagttggtttctggggaggccacggtggctgagctggatggatggactggagccagatactgagtatacggtgcatgtgagggcccatgtggctggcgtggatgggccccctgcctctgtggttgtgaggactggtgagtggaccc

SEQ ID NO: 10626 - DNA, 205 bp, Artificial Sequence
  Synthetic polynucleotide
gtgatgacgatggacagggtgacgaagatcatggtgaacagcaggtactcgccgatgagtgggatgaccagtgaggtggacgggatgatctcggtgatgagcagcagcaggaagacggtgagcgacagcagcacggagatgcacagcgtgatcttctcgccacactcggagggcaggtagaagaccagcacggtgaggcaggaga

SEQ ID NO: 10627 - DNA, 205 bp, Artificial Sequence
  Synthetic polynucleotide
tgacttttcccttgcttctctttttcaccttcccacagtgtccactcccctcggccagggccgcgtcaaccagctcggcggtgtttttatcaacggcaggcaggccgctgcccaaccacatccgccacaagatcgtggagatggcccaccacggcatccggccctgcgtcatctcgcgccagctgcgcgtgtcccacggctgcgt

SEQ ID NO: 10628 - DNA, 205 bp, Artificial Sequence
  Synthetic polynucleotide
cgaggcccaggaggtggggcagcttctgcagcagcacatggagtgcgccattgggcaggcgctgctggtgcatgcacggaatgcagccaccaagagccggccgggccaaggacagggatgacttcaaggtatgcactgacctctgtccctggggacaccgagggcaagaatgttcagggtagggtccatgcctgggtctgctcct

SEQ ID NO: 10629 - DNA, 205 bp, Artificial Sequence
  Synthetic polynucleotide
cccctcctccaccctcgccccctcctctctgttctcctcccctctctgaggcccattctctgtttcccacagacacggagcagccaggggaggtgtcggccggccttggggccgggccgggcgggggcagggccgagtagccggggccggccgggggggccgtggggggagagcccgtccagtggcccctccagccctgagagca

SEQ ID NO: 10630 - DNA, 204 bp, Artificial Sequence
  Synthetic polynucleotide
acccaaattcttggagttgatgttgactgtggaattctaatgtgcttggctcttagggtatgactggtttccctggtgctgctggacggactggtccccccccaggaccctctgtaagtaaatcactgtaaacgtgtcttcatttactctagccaaaaggcctggcttctgataggaaactggtaagaaactcttcatgaaaac

SEQ ID NO: 10631 - DNA, 207 bp, Artificial Sequence
  Synthetic polynucleotide
cagtgtcctcatgccaacccctttcccccagtgtgggtctcagaggtcatgctgcagcagacccaggttgccactgtgatcaactactataccggatggatatggatgcaggtgactccaggggaggaagggaagggtcatgggtcagaccccagatgagagcctctactttggggtgggtgtagagaaggcttcctctaccacctt

SEQ ID NO: 10632 - DNA, 213 bp, Artificial Sequence; identical to SEQ ID NO: 10165
  Synthetic polynucleotide

SEQ ID NO: 10633 - DNA, 209 bp, Artificial Sequence
  Synthetic polynucleotide
cggccccgggacagcgggcggctggacaaagcgtcgcccgactcacgccatagccccgccaccatctcgtccagcactcgcggcctgggcgcggaggagcggaggagcgcaggagcccggttcgcgagggcacagcgccggccaaggtggaagaggcgcgcgcgctcccgggcaaggaggccttcgcgccgctcacggtgcagacggac

SEQ ID NO: 10634 - DNA, 211 bp, Artificial Sequence; identical to SEQ ID NO: 10368
  Synthetic polynucleotide

SEQ ID NO: 10635 - DNA, 204 bp, Artificial Sequence
  Synthetic polynucleotide
gcacgggccgcgcacgcagcgccgcgctgccgcgcagatcgcgcaggcactgctgggcgccgaggagcgcaaagtggaaatcgccttctaccggaaagatgatggtaggagcgggccggggcggggccacgaccaggggcggggtcaagaggggcgggaccacggcgaggggcagggtgcgtgggggtgtgggggtgtgggggc

SEQ ID NO: 10636 - DNA, 205 bp, Artificial Sequence
  Synthetic polynucleotide
gagccgcgtttctttcctcactggcaggagacctgacaccacccgcctgtacgacttcaactcctactggagggtgcacgctggaaacttctccaccatccatcccccagtacttcaaggagaatggctatgtgaccatgtcggtgggaaaagtctttcaccctggtactgctccatgtccagagtctgggttctcttggtttgt

SEQ ID NO: 10637 - DNA, 205 bp, Artificial Sequence
  Synthetic polynucleotide
atactgtctgtccccacaggtggtctccgtgggcatcaaagacgtgtttgacttcatcccaggctcagaccagctcaatgtcatttcttgccaaggcctgcctggcaccatcccagggccggcccggcctctcgctggtcaaggagaactatgcagagctgctggaggatgccttcctgaagaatgtcaccgcccagatctgcat

SEQ ID NO: 10638 - DNA, 207 bp, Artificial Sequence
  Synthetic polynucleotide
gctcctagagaccacagccccccctcacagggcagccccggcaacagtgcggccagggactcaggcggccagacgtccgccgggtgtccctctggctggctggctgggcacgagacggcggggcctggtgatggaggccccccagggcagcgaggccacactgcctggccctgcccctggcgagccctgggaagcaggcggccccca

SEQ ID NO: 10639 - DNA, 215 bp, Artificial Sequence
  Synthetic polynucleotide
ctggtggtcttccgcatcgtgctgacggctgtgggcggcgaggccatctactcggacgagcaggccaagttcacttgcaacacgcggcagccaggctgcggcagccaggctgcgacaacgtctgctatgacgccttcgcgcccctgtcgcacgtgcgcttctgggtcttccagattgtggtcatctccacgccctcggtcatgtacctgggctac

SEQ ID NO: 10640 - DNA, 204 bp, Artificial Sequence
  Synthetic polynucleotide
ctgtctcacacagattccacccccgttttccgttgctccaggatctgcggcggaaagcggcccggctggtggccgccaagtgcacactggcagcccgtgttgtggacagtttccacgagagcacagaagggaaggtgaggagggaaaggtgaggggcggccgggcgtcttttcctctgggcctggggtgtctctgcagggagac

SEQ ID NO: 10641 - DNA, 205 bp, Artificial Sequence
  Synthetic polynucleotide
ggggtcgttctgggagctgtgatcgggggtgtcctcggggtggtgctgttgctgctgctgcttttctacgtggttcggtactgctggctacgcaggcaggcaggcggccctgcagaggaggctcaggtaaggggcggagcctagctcccctccccctctccccactatcccccatctgggcggagactactccagtgggtgggag

SEQ ID NO: 10642 - DNA, 208 bp, Artificial Sequence
  Synthetic polynucleotide
ggacgcacgggcatggggaccccggggagccagatggcccccgtgagcctgaatgtgccccgacccaaccaggtgagcgggcccgtcatgcccagcatgccgcatgcctcccgggcagtggcagcaggcgccccttccccagcagcagcccatgccaggcttgcccaggcctgtgatatccatgcaggcccaggcggccgtggctggg

SEQ ID NO: 10643 - DNA, 205 bp, Artificial Sequence
  Synthetic polynucleotide
ggagaggtggtgcccttgggaggtcttgggcaggggtgggatataactggggggcccagctgattccctccccttccactccaggcctggcctccacgcacgcaggcacagagtgtgccggtcatcaacagcatgggcagcagcctgaccaccctgcagcccgtccagttctcccagccgctgcacccctcctaccagcagccgc

SEQ ID NO: 10644 - DNA, 204 bp, Artificial Sequence
  Synthetic polynucleotide
agcaattatagatcagtttggtcagagaataatctctgagcatttcctcgtggaggacagttactttcctgagaacatgtgctcacgtgtgcaatacaggtggtaaggccccctccacccattagcaagcgaaggtaattttattgacattcctgtgtaattctgttcttcaagtaacatgcaaataaatgccaaaccaaagat

SEQ ID NO: 10645 - DNA, 205 bp, Artificial Sequence
  Synthetic polynucleotide
tgtgccaccagacagcatacctggttccgcaggtcctggcttaggccctggcactggtccagggggacccctccagccagctccatgcccagcacccgtgtcgtcgtgcacagctccttaaccacggctgggacccggaagaaggggtcatttgccagcagctgcctggggcagaaggaaagggaggaaggggacttcgtgcttc

SEQ ID NO: 10646 - DNA, 207 bp, Artificial Sequence
  Synthetic polynucleotide
ccttgcccgctccggggctgctcgcgatccccacgaccacgtgcctctcctctcccgcaggccgcgccaagaccttccgcctgaagctgcccgcgctgctgctgctggcgctgacggcccgggagtcgtcggtgcggtcgggcggcgcgggcggcgcgggcgccccgggggccgtggtggtggacgtggacctgacgcccgcggcac

SEQ ID NO: 10647 - DNA, 206 bp, Artificial Sequence
  Synthetic polynucleotide
gggccctaggggattttaagcaggttccaggaaccccccgttcagttcctggtcccccactttctcaaccccacagatgctccgggcccctgcccctgccctgccccagctatggctcctggggctccctcatccagccccagccctatcctggctgtgctgctcttctcttctttgggtaagtggagccactctactctgggagt

SEQ ID NO: 10648 - DNA, 206 bp, Artificial Sequence
  Synthetic polynucleotide
gacatcgagcggctgggccgcttcctctggtcgctgcccgtggcccccggggcgtgcgaggccatcaacaaacacgagtcgatcctgcgcgcgcgcgccgcgccgtggtcgccttccacacgggcaacttccgcgacctctaccacatccttgagaaccacaagttcaccaaggagtctcacggcaagctgcaggccatgtggctc

SEQ ID NO: 10649 - DNA, 205 bp, Artificial Sequence
  Synthetic polynucleotide
ggcaccgaaggcgcccgaggcgacgctgggtccgtgctggggctgttcgtgcggctctgatcccggggtgggcagagcggggcttccgggtgggcggcccgcccgtggcactcctgtaccgctgctgcttttgtggtgaagaccacccgcggcagggcagcatcctctacagcttgctcactagctcaaagcaaacgcacgtggc

SEQ ID NO: 10650 - DNA, 206 bp, Artificial Sequence
  Synthetic polynucleotide
cccctgaccagcgcgtcgaccgcggccgcgctcctgagacagcccacacccgccgtggagggcgcagtggcatcgggcgccctggccgacccggccacggcacggcggccgcagacagacgcgcctctagcatagccgcgctgaggctcaaggccaaggagcacgcggcgcagctcacgcagctcaacatcctgccgggcaccagc

SEQ ID NO: 10651 - DNA, 211 bp, Artificial Sequence
  Synthetic polynucleotide
ccagggctcccgcgggcccagccggcaggacgcggcctcccccgctcctccagcccgcggccgcggcggtactcacagacctgttctgcagccgccgccgccgctgccgctgccgccatcttcccgcgcccgccgccgccgagctccccgcccgactgtgcccgcccctccgcgaccgcaccctgcgcgcctgcgcttgcgccctggcggg

SEQ ID NO: 10652 - DNA, 220 bp, Artificial Sequence
  Synthetic polynucleotide
ctccccgcagcccgctagacgagccgatggcgcggccccggagagcccgggagccgctgctcgtggcgctgctgccgctggcgtggctggcgcaggcgggcgtggctggcgcaggcgggcctggcgcgcgcggcgggctctgtgcgcctggcgggcggcctgacgctgggcggcctgttcccggtgcacgcgcggggcgcggcgggccgggcgtgcgggc

SEQ ID NO: 10653 - DNA, 212 bp, Artificial Sequence; identical to SEQ ID NO: 10086
  Synthetic polynucleotide

SEQ ID NO: 10654 - DNA, 206 bp, Artificial Sequence
  Synthetic polynucleotide
cgctgctcatccttgcctctagctgcctattgctcgtggggctttgttgctggcccgccccgatcagaggtgcaatgctgggttttggcaggagctgctgggctggcactgctgaagtgtgtggaggctgagattgcaaactatgaggcgtgcctcaaggaggaggtagagaagaggaagaagttcaaggtgggtgatttctccag

SEQ ID NO: 10655 - DNA, 204 bp, Artificial Sequence
  Synthetic polynucleotide
ccgacccgtgcacgacgctgcccgggagggcttcctggacacgctggtggtgctgcaccgggccggggcgcggctggacgtgcgcgatgcctggggccgtcgtctgcccgtggacctggctgaggagctgggccatcgcgatgtcgcacggtacctgcgcgcggctgcggggggcaccagaggcagtaaccatgcccgcataga

SEQ ID NO: 10656 - DNA, 206 bp, Artificial Sequence
  Synthetic polynucleotide
ctgggcgctatgaggtccgggcagaggtgggcaatggcgtgtccaggcacaacctctcctgcagctttgacgtggtctccccagtggctgggctgcgggtcgggtcatctaccctgccccccgcgacggccgcctctacgtgcccaccaacggctcagccttggtgctccaggtggactctggtgccaacgccacggccacggctc

SEQ ID NO: 10657 - DNA, 205 bp, Artificial Sequence
  Synthetic polynucleotide
gggggctgaaggggagtaaaaaagagcccagggaggtggctggggcgggaggaatggatagaggggtgaggagagggagagaaactgacacagaaaagagaggagaggagagaggtttggggcaggggagagaagccagccagagtgggggcggcaggagatagtggagggggtgggggccaaggtggggccacaggaagagagg

SEQ ID NO: 10658 - DNA, 205 bp, Artificial Sequence
  Synthetic polynucleotide
caaggcccagttagacgcagctgtgaccttcggccccagccaggtggcccggggcgaggaccccgccctgcagatctgctgtcatcctggctgcaccccccccccgcccagcttgctgccattgcccagatccccatgcctgagggcccctcggctggcctgggcatgtgatggctcctcactgggagcctgtgggggaggctca

SEQ ID NO: 10659 - DNA, 205 bp, Artificial Sequence
  Synthetic polynucleotide
ccaagccccgagggtgacccgcgcttcagcttcctcctccacttctacacagtacccatacccaaaaccggcaccctcagctgcacggtagccctgcgtccgtcccaagaccgggtctcaagaccaggtgagtggggcctgggccggccccagcttcaagtgggagcttccaggtctgtggtttgcaggaagggacatggcagcc

SEQ ID NO: 10660 - DNA, 205 bp, Artificial Sequence
  Synthetic polynucleotide
ccccctcctctctgttctcctcccctctctgaggcccattctctgtttcccacagacacggagcagccaggggaggtgtcggccttggggccgggccgggccggcgggggcagggccgagtagccggggccggccgggggggccgtggggggagagcccgtccagtggcccctccagccctgagagcagtgaggatgagggccca

SEQ ID NO: 10661 - DNA, 204 bp, Artificial Sequence
  Synthetic polynucleotide
tgatctgcttgaatatggtgaccatgatggtggagacagatgaccaaagtcctgagaaaatcaacatcttggccaagatcaacctgctctttgtggccatcatcttcacaggcgagtgtattgtcaagctggctgccctgcgccactactacttcaccaacagctggaatatcttcgacttcgtggttgtcatcctctccatcg

SEQ ID NO: 10662 - DNA, 212 bp, Artificial Sequence
  Synthetic polynucleotide
tgcccggggtgcccggcgcggtcctgaccctctgcctctggctggcggcctccagcggctgcctggcggccggccccggcgcggctgctgcgcggcggctgcgcggcggctggacgagtcgctgtctgccgggagcgtccagcgcgctcgctgcgcctccaggtgcctgagcctgcagatcactcgcatctccgccttcttccagcacttcc

SEQ ID NO: 10663 - DNA, 206 bp, Artificial Sequence
  Synthetic polynucleotide
tattttggacagatatcatcaacgaagccattttcagtgccaaccgcctcacaggttccgatgtcaacttgttggctgaaaacctactgtccccagaggagaggatatggttctcttccacaacctcacccagccaagaggtaagggtgggtcagccccacccccccaaccttgaaacctccttgtggaaactctggaatgttctg

SEQ ID NO: 10664 - DNA, 204 bp, Artificial Sequence
  Synthetic polynucleotide
tccccagatggtgctcctggccaggtgcgaggggcactgcagccaggcgtcacgctccgagcctttggtgtcgttcagcactgtcctcaagcaacccttcctccgttcctcctgtcactgctgccggccccagacttccaagctgaaggcactgcggctgcgatgctcagggggcatgcgactcactgccacctaccggtacat

SEQ ID NO: 10665 - DNA, 212 bp, Artificial Sequence
  Synthetic polynucleotide
gtgactggctgaggcggcgccagttggccgggcacggggctgctgtaaggccgaggttgcggcggaagcggagaccatgttccgagcggcggctccggggcggctccggggcagctccggcgggcggtgagtccggactgggaaggcgaacccagggacggccccccgtcaacccgccgtccctatggggtcttgcaaagatcactggcccc

SEQ ID NO: 10666 - DNA, 204 bp, Artificial Sequence
  Synthetic polynucleotide
caacgaggagaaggcgcagcgtgaggccaacaaaaagatcgagaagcagctgcagaaggacaagcaggtctaccgggccacgcaccgcctgctgctgctgctgggtaagggcgggcggggggcgccggccccggcccgggggccctcgaagggcgccccgcaggccgcgcgcgccgagcccgccccccgccccgggcgcgcgct

SEQ ID NO: 10667 - DNA, 205 bp, Artificial Sequence
  Synthetic polynucleotide
gtacctccggggtggcgctggggttggctccatgaccaagatctatgggggacgtcagagaaacggcgtcatgcccagccacttcagccgaggctccaaggcagagtgtggcccgccgggtcctccaagccctggaggggctgaaaatggtggaaaaggaccaagatgggtaagcagggtagggggggctgcattgatggagtag

SEQ ID NO: 10668 - DNA, 206 bp, Artificial Sequence
  Synthetic polynucleotide
tgttcctgaggctcttgccccagctgctgaggatgcacgttcgcccgctggccccggcagctgtgcaggacacccagtcccggctacagaatggctcctctcctcgggatggtcgatcacaactggggaggaggtggccctctgcctgcctcgcagtgaactcctcttccagcagtggcagcggcaagggctggtggcggcagcgc

SEQ ID NO: 10669 - DNA, 204 bp, Artificial Sequence
  Synthetic polynucleotide
gagtgccaggcccccaagggtcatctccacaaaagaatgcagggggcacagccctcatggtcccattgttccccggccaggtgaactgtgtggtgatgcgacgaggccttaacgaggatgaactcctggactttgcggccttgactgagggcctccccctggatgtgcgcttcatagagtatatgccctttgatggtcagtgac

SEQ ID NO: 10670 - DNA, 206 bp, Artificial Sequence
  Synthetic polynucleotide
acaatggcggctgctcccacctgtgcctgctgtccccaagcgagcctttctacacatgcgcctgccccacgggtgtgcagctgcaggacaacggcaggacaggacgtgtaaggcaggtgaggcggtgggacgggacggggcgggcgggcggggcggggcctggcgggaatgggttgcggccgccgggggtgccccagaaggaacct

SEQ ID NO: 10671 - DNA, 205 bp, Artificial Sequence
  Synthetic polynucleotide
cagtcggggccgccagtaccaggagctccctcgatgccccgcccccacccccagcctcctcaacatccccctctccagcccgggtcggcggccccggggcgggcgacgtggagagcaggctggatgccctccagcgccagctcaacaggtgagggagtgcaggtggggtgggggggcacgccctggagtctggtccaggtcctgg

SEQ ID NO: 10672 - DNA, 205 bp, Artificial Sequence
  Synthetic polynucleotide
gtccccccagcgaacccacccacctggcagtagaggacgtctctgacaccacggtctccctcaagtggcggcccccagagcgcgtgggagcaggaggcctgcctggatggctacagcgtggagtactgcccagagggctgtgagtgtccccgcccccaacccccctccccaaaggaagaacatgctcaccttgccattgagcaga

SEQ ID NO: 10673 - DNA, 205 bp, Artificial Sequence
  Synthetic polynucleotide
tgtctgagaacatgctgtgtgcgggcatcctcggggaccggcaggatgcctgcgagggcgacagtggggggcccatggtcgcctccttccacggcacctgcctggttcctggtgggcctggtgagctggggtgagggctgtgggctccttcacaactacggcgtttacaccaaagtcagccgctacctcgactggatccatgggc

SEQ ID NO: 10674 - DNA, 204 bp, Artificial Sequence
  Synthetic polynucleotide
ccccgcgttccggacgcgggggaacgcgaacaccgtgtgggtggactaccccaatattgtccgggtcgtgccggtggggggccgcatctacattgacgacgacgggctcatctccctagtggtccagaaaatcggtgcggacgcgcctcccgccctgaccacatccgtgcgctgggcacattcccttctccttggctcccccat

SEQ ID NO: 10675 - DNA, 202 bp, Artificial Sequence
  Synthetic polynucleotide
ggctggcaggcacccacttgccgttggcccccactgtctcctttgcttgcagagctgtccgaggttctgtgggccatggtgatgcgcataggcctgggccctgggccgggaggtgggcgtggcggctgtggtgctggtccccatctttgccgcctttgccgtgatgaccgtggctatcctgctggtgatggagggactctca

SEQ ID NO: 10676 - DNA, 204 bp, Artificial Sequence
  Synthetic polynucleotide
ttgacgagcagagtggaaaggagaagtacaagcttctggtggaaggtgataacctgcgggcagtcatggccacacacggtgtgaagggcacccgaaccaccacctccaataacacctatgaggtaccactcagcccacggggtcgccttagggttaggctgtcttccttgtgccatctgcaggccttccactgattcccagtat

SEQ ID NO: 10677 - DNA, 210 bp, Artificial Sequence; identical to SEQ ID NO: 10266
  Synthetic polynucleotide

SEQ ID NO: 10678 - DNA, 205 bp, Artificial Sequence
  Synthetic polynucleotide
tcaggtaagtggtggtcaccagtcctctgccctcttcttcagggggccatggtcttcgagttggcgccctggacgtgccggcctcccagttcctgggcaggcagtgccacttctccaggaccacggactgcaccagccgcgaaacctgagaaggcctcagctggcacccgggttcctgtgcaggagaagacgaacctggcggcct

SEQ ID NO: 10679 - DNA, 205 bp, Artificial Sequence
  Synthetic polynucleotide
ctctgtggtatctgaactatcttctctaactgcaggttgggctcagatctgtgatagaacagtttcctgggaagcttgactttgtccttgtggatgggggggggctgtgtcctaagccatggccacaagcagttgatgtgcttggctagatctgttctcagtaaggcgaagatcttgctgcttgatgaacccagtgctcatttgg

SEQ ID NO: 10680 - DNA, 207 bp, Artificial Sequence
  Synthetic polynucleotide
cagggggatgaggattggtgtccagattcacaacacctggctgaatcctgatgtggtcaccacttacctacgggagaagcaccagatccgagtccgagcccgagcccagaggcttccagaagtacaggtctgtgtctctttccagtcccatggagctgaactctggaaggaataaagtcccatgtagcaggagcactgactgggagt

SEQ ID NO: 10681 - DNA, 219 bp, Artificial Sequence
  Synthetic polynucleotide
aacgacatccgcccgtggtgcttcgtgctgaaccgcgaccggctgagctgggagtactgcgacctggcacagtgccagaccccaacccaggcggcgcctccaacccaggcggcgcctccgaccccggtgtcccctaggcttcatgtcccactcatgcccgcgcagccggcaccgccgaagcctcagcccacgacccggaccccgcctcagtcccagacc

SEQ ID NO: 10682 - DNA, 202 bp, Artificial Sequence
  Synthetic polynucleotide
gaactgctccaagggagaaacttctgggagcctccaaactcctagctgtctcatcccttgccctggagagacggcagaaccatggcattttatagctgcttgctgggtcctcttggcactcacctggcacacctctgcctacgggccagaccagcgagcccaaaagaagggggacattatccttggggggctctttcctatt

SEQ ID NO: 10683 - DNA, 211 bp, Artificial Sequence
  Synthetic polynucleotide
cggctcctgggacactggatggggcaggcacagcccctcccatcgctgccgtccgtccccccagggcgccgagaccaggaagcgctcgcccacacttagcagccacagccagttcaagcggtcactggagctgctgatgcgcacgctgggtgcctgccagcccttctttgtgcgatgcatcaagcccaatgagttcaagaagcccatggtg

SEQ ID NO: 10684 - DNA, 206 bp, Artificial Sequence
  Synthetic polynucleotide
ggagggccacagggtcacgtggaccggccgcttcaagtacgtccgcgtgactgacatcgacaacagcgccgagtctgccatcaacatgctcccgttcttctcttcatcggcgactggatgcgctgcctctacggcgaggcctaccctgcctgcagccctggcaacacctccacggccgaggaggagctctgtcgccttaagctgct

SEQ ID NO: 10685 - DNA, 205 bp, Artificial Sequence
  Synthetic polynucleotide
catgcttgtggccatgaagtggctgtttgaagagtttgccatagatgggcgcttctgcatcagcatccatgacgaggttcgctacctggtgcgggaggagggaggaccgctaccgcgctgccctggccttgcagatcaccaacctcttgaccaggtatgcggggcccatggcctctagcctggccatgtgctcctatgtggggct

SEQ ID NO: 10686 - DNA, 207 bp, Artificial Sequence
  Synthetic polynucleotide
agggagctgtagctggatgctccctgctccccacaggcatcgtgaaggcctactacgtgcgtgcccgggctcacgcagaggtgtggaatgaggccgaggccgaggccaaggcggacctccagaaagtgctggagctggagccgtccatgcagaaggcggtgcgcagggagctgaggctgctggagaaccgcatggcggagaagcagg

SEQ ID NO: 10687 - DNA, 217 bp, Artificial Sequence; identical to SEQ ID NO: 9988
  Synthetic polynucleotide

SEQ ID NO: 10688 - DNA, 215 bp, Artificial Sequence
  Synthetic polynucleotide
gccctgatgggcagctgggtcgccagattagccacttcttctcggagaatgaggatttccgctgcattgctggcatgtgtgtggatgctcgtggtgatctgctcgtggtgctctcatcgtggctgacagtagtcgcaaggaaattctccattttcctaagggtgggggctatagtgtccttattcgagagggacttacctgtccggtgggcatag

SEQ ID NO: 10689 - DNA, 205 bp, Artificial Sequence
  Synthetic polynucleotide
tgttgtgatgcgtattcccgtagatccgagcaccagccggcgcttcagccccccctccagcagcctgcagcccggcaaaatgagcgacgtgagcccggtgtccggtggctgcgcaacagcagcagcaacagcagcagcagcaacagcagcagcagcagcagcaacagcagcagcagcagcaggaggcggcggcggcggctgcggc

SEQ ID NO: 10690 - DNA, 205 bp, Artificial Sequence
  Synthetic polynucleotide
ggcccttctcagctggttccagccagctggcctctgcctaactcactcccctctctcctgacccacagcccagcacggccccacccaagcccaagccgcccgcctccgctgaccaaggagacagtggtgttctgggacatgcgcctgtggcacgtggtgggcatcttttcgctcttcgtgttgtccatcagtgagtagctgttcc

SEQ ID NO: 10691 - DNA, 206 bp, Artificial Sequence
  Synthetic polynucleotide
tttccctcagcctggacccccgcagccccatctcttcagcacacccaccctgggctcctcggcctggcctgatcttctcatcccctaacaggccgcgccgagccgacttcctggagcagccggtgctgggcttcgtgaggctgcaggaggcagcggagctggaggcggtggagctgccggtgcctatacgcttcctctttgtgttg

SEQ ID NO: 10692 - DNA, 208 bp, Artificial Sequence; identical to SEQ ID NO: 10348
  Synthetic polynucleotide

SEQ ID NO: 10693 - DNA, 208 bp, Artificial Sequence
  Synthetic polynucleotide
gttaggtgaagtgattatccaggtgtttgatcacgttaattccctatcttgctgcagaaactcagaggatttcctcatcacaacagcacccacatttacgatttacgtaaagtttcagtgtctgaatcaaatgttctcttggatgaagaagtacttactgatccgaagatccaggcgctgcttcttactgttctagtaaggatttccc

SEQ ID NO: 10694 - DNA, 205 bp, Artificial Sequence
  Synthetic polynucleotide
caggaccgcttgcagttcgagactgtggaagtctcggagcccagcatgctgcagaagatcctcaccaccaggcggcgggagaccgggggcaacgagccactcactgcccgtgcccacgctgcagcaccatttggcaccgccggcggaggccaggaaggtgccctccgcctcccaggtccaagccatcaagtgctttctttccaaa

SEQ ID NO: 10695 - DNA, 206 bp, Artificial Sequence
  Synthetic polynucleotide
tcacgctgcgcctcgagttcccggcggccggccgcgccctggccgccctcagcgtccgcccctttgcgctgcgccgcctcagcgcgggcctctcgctgccttgcctctgctcacctcggtacgcccgtccccggccagaccccgcgcctcccaccggcagcgtcccgccccctcgcggggccccgccccggcagcgtctcacccct

SEQ ID NO: 10696 - DNA, 210 bp, Artificial Sequence
  Synthetic polynucleotide
gcgctgcgcggcctggccaacctgacgcacgcgcacctggagcgcggccgcatcgaggcggtggcctccagctcgctgcagggcctgcgccgcctgcgctgcctgcgctcgctcagcctgcaggccaaccgcgtccgtgccgtgcacgctggcgccttcggggactgtggcgtcctggagcatctgctgctcaacgacaacctgctggcc

SEQ ID NO: 10697 - DNA, 202 bp, Artificial Sequence
  Synthetic polynucleotide
ccggcccgacccgaccgcacccggcgcctgccctcgctcggcgtccccggccagccatgggcccttggagccgcagcctctcggcgctgctgctgctgcttgcaggtaccccggatcccctgacttgcgagggacgcattcgggccgcaagctccgcgccccagccctgcgccccttcctctcccgtcgtcaccgcttccct

SEQ ID NO: 10698 - DNA, 205 bp, Artificial Sequence
  Synthetic polynucleotide
caggcagaccatgtggaccctggtgagctgggtggccttaacagcagggctggtggctggaacgcggtgcccagatggtcagttctgccctgtggcctgcctgctgcctggaccccggaggagccagctacagctgctgccgtccccttctggtgagtgcccctcagcctaggcaagagctggcagcctgggttttcccaaaggg

SEQ ID NO: 10699 - DNA, 205 bp, Artificial Sequence
  Synthetic polynucleotide
tacgtggttgccctgggagcccacaccggggaggagagcgtggctgaccatcacgaggctgaatattatgtggctgccgtgtatgagcatccatccatccatcctgagtctgaaccctctggctctcatcagccgccaagaggccttggagctcatgaaccagaaccttgacatctatgaacagcaagtgatgactgcagcccaa

SEQ ID NO: 10700 - DNA, 205 bp, Artificial Sequence
  Synthetic polynucleotide
cccaagcagccacagtccccccgccgcgatggcgctgcaaagccaggcgagcgaggaagcaaaggggccctggcaggaggcagaccaggaacagcaggagggagccggtgggtagcccagagccggagtctgagccggagcctgagcccgagcccgagcccgtgccagtgcccccgcccgagccccagccggagccccagcccct

SEQ ID NO: 10701 - DNA, 204 bp, Artificial Sequence
  Synthetic polynucleotide
gttctgtgaccccttttcctcatctctgcctgcttcctcacagcttgaggcagccctaggtgaggccaagaagcaacttcaggatgagatgctgcggcggcgggtggatgctgagaacaggctgcagaccatgaaggaggaactggacttccagaagaacatctacagtgaggtggggactgtgctttgcaagccagagggctg

SEQ ID NO: 10702 - DNA, 205 bp, Artificial Sequence
  Synthetic polynucleotide
gagcctgccgggaggaagctccctggaaaccagcccccgcctcttccaggggtggttggggggaccctccaggcggccaccatctgtgcctccagccacccaccagtttctctccacacactacaacctgcacaacctctacggcctgaccgaagccatcgcctcccacaggtgagggccacgtcccgccccactgggctctgcc

SEQ ID NO: 10703 - DNA, 205 bp, Artificial Sequence
  Synthetic polynucleotide
tctggggggacagtcggggccgccagtaccaggagctccctcgatgccccgcccccacccccagcctcctcaacatccccctctccagcccgggtcggcgggcggccccggggcgacgtggagagcaggctggatgccctccagcgccagctcaacaggtgagggagtgcaggtggggtgggggggcacgccctggagtctggtc

SEQ ID NO: 10704 - DNA, 206 bp, Artificial Sequence
  Synthetic polynucleotide
ggccaggccccgcggccgacttctccgtgtcggtggagcgcgctctggctgccaagccgggcttggacacctacagcctgggcggcggcggcgcggcgcggcgcgcgtgcgggtgcgcggctccacgggcgtggcggccgccgcggggctgcaccgctacctgcgcgacttctgtggctgccacgtggcctggtccggctctcagc

SEQ ID NO: 10705 - DNA, 205 bp, Artificial Sequence
  Synthetic polynucleotide
atggtgattctaggtttgtcagctcctgtgccaaggggaaggaagggaaagaaggtgaaagcccagagcacacagccggtggtgcaggatgccgactggccagctggccagctgcaacccagatgccctgttccaggaggacagctacaagaaacacctgaagcatcactgtaacaagtatgttattagagggtggacctggaga

SEQ ID NO: 10706 - DNA, 206 bp, Artificial Sequence
  Synthetic polynucleotide
ggcatttctgccaccctccctctgctttacaatcaggctctcctccttcagatgagatccgcaccctccgagaccagttgcttttactgcacaaccagttagtttactctatgagcgttttaagaggcagcagcatgccctccggaacaggcggctcctccgcaaggtgatcaaagcagcagctctggaggaacataatgctgcca

SEQ ID NO: 10707 - DNA, 206 bp, Artificial Sequence
  Synthetic polynucleotide
tgcagcccggggggtgtccgggctgagcgggctcacccggttgttgtggcgcgcctgctccagagtggcggtgaagaggaagcagcggcaggggacgcccggctcgcggctcgggcacactggacgtacctgtgggggaaggagctggatgtgcaggccccgcccaccccgccgcaggccacctacggccccgcggtcacgctacc

SEQ ID NO: 10708 - DNA, 206 bp, Artificial Sequence
  Synthetic polynucleotide
gtcgtgctcccggcaggcgtggagccgcgataaccccggcttcgaggccgaggaggaggaggaggaggtggaaggggaagaaggcggaatggtggtggagtggagatggacgtagagtggcgcccgggcagccggaggtcggccgcctcctcggccgtgagctccgtgggcgcgcggagccgggggcttgggggctaccacggcgc

SEQ ID NO: 10709 - DNA, 212 bp, Artificial Sequence
  Synthetic polynucleotide
ctaagtggcgagtgcatccactccagctggcgctgtgatggtggccccgactgcaaggacaaatctgacgaggaaaactgcggtatgggcggggccagggcggggccagggtgggggcggggcgtcctatcacctgtccctgggctcccccaggtgtgggacatgcagtgatttaggtgccgaagtggatttccaacaacatgccaagaaag

SEQ ID NO: 10710 - DNA, 213 bp, Artificial Sequence
  Synthetic polynucleotide
cctcctttcttccctctctccaccagagcgatcgcctcaccggcccatcctccaagccggactgccggcaaatgcctccacagtggtcggaggagacgtaggaggagacctagagtttgtctgcaaggtttacagtgatgcccagccccacatccagtggatcaagcacgtggaaaagaacggcagtaaatacgggcccgacgggctgcccta

SEQ ID NO: 10711 - DNA, 218 bp, Artificial Sequence
  Synthetic polynucleotide
cacacgcgtgcagagcatggcgctgccccccggcgtagtgaactcgtacaatggcctgggaggcccgccggccgcacccccgcctccgccgcacccccacctccgccgcacccccacccgcatccgcacgcacaccatctgcacgcggccgccgcaccgccgcctgccccaccgcaccacggggccgccgcgccgccgccgggccagctcagccctgc

SEQ ID NO: 10712 - DNA, 201 bp, Artificial Sequence
  Synthetic polynucleotide
ggagtggggaggggtatcttgggcctagctaagttgtgtttttctttttcatttcacagggtccttctggtcctgttggtcctgctggtgctgttggcccaagaggtcctagtgtatgtacatgctgaagatttctttgcaacactaacatttagagagaatcagtccaaaacatctgttaagaaaataaacaatatatca

SEQ ID NO: 10713 - DNA, 201 bp, Artificial Sequence
  Synthetic polynucleotide
gcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccg

SEQ ID NO: 10714 - DNA, 201 bp, Artificial Sequence
  Synthetic polynucleotide
ctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccggg

SEQ ID NO: 10715 - DNA, 214 bp, Artificial Sequence
  Synthetic polynucleotide
cccctctgaagacaaggaggacattgaaagcaacctgctccggcccacaggcgtagccctgcgaggagcccacttctgcctgaaggtcttccgggccgaggacttgccgcagagtgcgtggggcgcgcccttgggtgggaggtctgcaggaggctggaggcgcagggctggtgggggtgggcgatggcgggcggggtcagctccctgggggaag

SEQ ID NO: 10716 - DNA, 201 bp, Artificial Sequence
  Synthetic polynucleotide
aaatctgactggactgtgtgtgtctctcctctgtgtcccccagggcccgtcacagctggagctgactctccaggcatccaagcaaaatggcacctggccccgagaggtgcttctggtcctcagtgtaaacagcagtgtcttcctgcatctccaggccctgggaatcccactgcacttggcctacgtgagtgtgttccctcc

SEQ ID NO: 10717 - DNA, 201 bp, Artificial Sequence
  Synthetic polynucleotide
gcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctg

SEQ ID NO: 10718 - DNA, 201 bp, Artificial Sequence
  Synthetic polynucleotide
gcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgac

SEQ ID NO: 10719 - DNA, 201 bp, Artificial Sequence
  Synthetic polynucleotide
cggggtggggcttcgtactaacctcgtcccctaagccccgcccctgccccaggttctcctggagctgctgccgcgcctcctgggctccccgccgccgcccgaggccccccgggccgcctcgcccccaaggcgggcgtcgtcggtgggcttattgctccgcgcggaggagctgatactgaaaaagccacggagcgagctcgt

SEQ ID NO: 10720 - DNA, 201 bp, Artificial Sequence
  Synthetic polynucleotide
ctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggtgt

SEQ ID NO: 10721 - DNA, 201 bp, Artificial Sequence
  Synthetic polynucleotide
agggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgt

SEQ ID NO: 10722 - DNA, 201 bp, Artificial Sequence
  Synthetic polynucleotide
aggctggaggctgatgcaaatcaggtgctggagtgggtacgggcaccacctcacgtccgatttccagctcgccaggcctggtaccggccagccagccccgaaagcctgcattaccacttgtgcagtgccccccgggccctgctgcaggatgtgctgcctaagtatatcctggacttctccctctttgcctacccactgcct

SEQ ID NO: 10723 - DNA, 201 bp, Artificial Sequence
  Synthetic polynucleotide
cggctgcgggcctgggccctcggccccactgaccctcttctctgcacagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgct

SEQ ID NO: 10724 - DNA, 201 bp, Artificial Sequence
  Synthetic polynucleotide
ttaaacatggatttttgaaaagtggattgaagacaaatctggttctttcctattagaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctc

SEQ ID NO: 10725 - DNA, 201 bp, Artificial Sequence
  Synthetic polynucleotide
gtgaaatcacaaaggagcgagaagatgagtgttttagttgtggggatgctggccagctcgtctcctgcaagaaaccaggctgcccaaaagtttaccacgcagactgtctcaatctgaccaagcgaccagcaggttggtgccaaaatccatttgtaccgctactcgttctctccatcatactcagggtctcatgccatttgc

SEQ ID NO: 10726 - DNA, 201 bp, Artificial Sequence; identical to SEQ ID NO: 10721
  Synthetic polynucleotide

SEQ ID NO: 10727 - DNA, 201 bp, Artificial Sequence
  Synthetic polynucleotide
cagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctg

SEQ ID NO: 10728 - DNA, 201 bp, Artificial Sequence
  Synthetic polynucleotide
tgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtgg

SEQ ID NO: 10729 - DNA, 201 bp, Artificial Sequence
  Synthetic polynucleotide
ccacagtgtatcggctagcctatctccggctaaatacactttgtgaacgccttctgtctgagcacccagaattagaacatatcatctggacccttttccagcacaccctgcagaatgagtatgaactcatgagagacaggcatttggaccaagtaagaaaatcaagcacttcaccttctctcctccctacttacttgttaa

SEQ ID NO: 10730 - DNA, 201 bp, Artificial Sequence
  Synthetic polynucleotide
gatgactttttcgtgttgaagttaactgaataacagctttctcagccaaggcaaagacacattgatttggttcttcctttgtagagagtgttcatctgggacttggatgagacaatcattgttttccactccttgcttactgggtcctacgccaacagatatgggagggtgagtaccaagaggcatcagtttttaatttct

SEQ ID NO: 10731 - DNA, 201 bp, Artificial Sequence
  Synthetic polynucleotide
ggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagt

SEQ ID NO: 10732 - DNA, 201 bp, Artificial Sequence
  Synthetic polynucleotide
cagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcg

SEQ ID NO: 10733 - DNA, 214 bp, Artificial Sequence
  Synthetic polynucleotide
tcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatg

SEQ ID NO: 10734 - DNA, 201 bp, Artificial Sequence
  Synthetic polynucleotide
cttgtcattgtttaatgcatacttaaacaattttatttttgtcttgaaattattaataatgtggttttctgtccacttcccctatgcaggtgtccaacggatgtgtgagtaaaattctgggcaggtattacgagactggctccatcagacccagggcaatcggtggtagtaaaccgagagtagcgactccagaagttgtaa

SEQ ID NO: 10735 - DNA, 201 bp, Artificial Sequence
  Synthetic polynucleotide
gtttcagcactctacccagaccctcccggccccagggtccacacgtgctcggccgcaggaggcttcagcaccagcgattacgacgttggctgggagagtcctcacaatggctcggggacgtgggcctattcagcgccggatctgctggggtgagcagagcgagggccccgggcgtctacgccaaggacaagggagtagttc

SEQ ID NO: 10736 - DNA, 201 bp, Artificial Sequence
  Synthetic polynucleotide
tcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatcgaaggctccctgtg

SEQ ID NO: 10737 - DNA, 201 bp, Artificial Sequence
  Synthetic polynucleotide
agtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagc

SEQ ID NO: 10738 - DNA, 201 bp, Artificial Sequence
  Synthetic polynucleotide
gctgatacagagggaggtcccctaactgttgaccttgtgaacagtaaggtcgttgtttcgttctgcagagagacggtgtccatcagcatccgggcctccctgcagcagacccaggctgtccctcttttgatggctcatcagtacctccgcggaagtgtagaaacccaggtgaccatcgcgacggccatcctcgcgggcgtc

SEQ ID NO: 10739 - DNA, 201 bp, Artificial Sequence
  Synthetic polynucleotide
tgcttgctgacgtggctctccatctcttcccagaaaaaattgcctgtgtcgtcccttcagaatgtgagaaatattgcggtaccaaggttggctgtaccaacatcgcctatccaaccttagtggtggagctcatgcccaatggtgagattctttcttgggaggttggtagagtctttcttgggaggctgattgggtttaggc

SEQ ID NO: 10740 - DNA, 201 bp, Artificial Sequence; identical to SEQ ID NO: 10723
  Synthetic polynucleotide

SEQ ID NO: 10741 - DNA, 201 bp, Artificial Sequence
  Synthetic polynucleotide
aaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtgt

SEQ ID NO: 10742 - DNA, 201 bp, Artificial Sequence
  Synthetic polynucleotide
aaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgg

SEQ ID NO: 10743 - DNA, 201 bp, Artificial Sequence
  Synthetic polynucleotide
atgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggcc

SEQ ID NO: 10744 - DNA, 201 bp, Artificial Sequence
  Synthetic polynucleotide
gtgcctcctttaaactgttttcatctcacaaggatgttagtagaaagtaaacagaagagtcatatctgttttcacagcccaattatacagaaatccgacagtactgcaatcactggcgaaattttgctgacattgatgattcctggaaaagtataaagagtatcttggactggacatcttttaaccaggagagaattgttg

SEQ ID NO: 10745 - DNA, 201 bp, Artificial Sequence
  Synthetic polynucleotide
cagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgg

SEQ ID NO: 10746 - DNA, 201 bp, Artificial Sequence
  Synthetic polynucleotide
tcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacc

SEQ ID NO: 10747 - DNA, 201 bp, Artificial Sequence; identical to SEQ ID NO: 10729
  Synthetic polynucleotide

SEQ ID NO: 10748 - DNA, 201 bp, Artificial Sequence
  Synthetic polynucleotide
ggaagtgcgagccaaggaccaggacatcttggatctggtgggtgtgctgcacgatcccgagactctgcttcgctgcatcgctgaaagggccttcctgaggcacctggtagggcctgtgctccacctgtggagggctggggacttggagagctgggaaaggtggcagggaagatttcttacatgaatgctctgtatacagtg

SEQ ID NO: 10749 - DNA, 201 bp, Artificial Sequence
  Synthetic polynucleotide
taagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggtttttt

SEQ ID NO: 10750 - DNA, 201 bp, Artificial Sequence
  Synthetic polynucleotide
ggtgaggagcatgggggagatgaggagccacgggccttgtgttgttacagagtttgctgtcatcgtggaggtccacgcagccgcacgttccaccctccaccctgtggggtgtgaggatgaccagtctctcagcaagtacgagtttgtggtgaccagtgggagccctgtagctgcagaccgaggtgggtgcccccaggcaga

SEQ ID NO: 10751 - DNA, 201 bp, Artificial Sequence
  Synthetic polynucleotide
gtgcctgccaggggggaggctcctaaggcccaccccggtgttttccccgccagctgccttctgccagagcctgggcgccgccgcccccgaggtccgctgctgtgtggatgccgtgaacttcgtggccgagagcacgagagatcaggaggccaccggcgaggtgggacaggagccagaggcgggtggagcgaggcagaggcc

SEQ ID NO: 10752 - DNA, 201 bp, Artificial Sequence; identical to SEQ ID NO: 10716
  Synthetic polynucleotide

SEQ ID NO: 10753 - DNA, 201 bp, Artificial Sequence
  Synthetic polynucleotide
ccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagg

SEQ ID NO: 10754 - DNA, 201 bp, Artificial Sequence
  Synthetic polynucleotide
agattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaag

SEQ ID NO: 10755 - DNA, 212 bp, Artificial Sequence
  Synthetic polynucleotide
ctccacattctctgccttttcatctctctctgctcggcccagaacacgatcgtgaatgagctggtacgtgtgaccagtgagggagctggcctgcagctgcagaaggtgactgtcctgggcgtggccacggcgccccagcaggtcctctccaacggtgtccctgtctccaacttcacctacagccccgacaccaaggcaagagggcccagagt

SEQ ID NO: 10756 - DNA, 212 bp, Artificial Sequence
  Synthetic polynucleotide
ccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggt

SEQ ID NO: 10757 - DNA, 201 bp, Artificial Sequence
  Synthetic polynucleotide
tagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatttaggtgcc

SEQ ID NO: 10758 - DNA, 201 bp, Artificial Sequence
  Synthetic polynucleotide
tgtattataacaatttataatcttcacaggccaatcacacaagctggaagacccattacaggtttcctcaggcccagcacgcagagtggaaggccaggcactatggaacaggctatcagaacacccagaaccgcctacacagcccgccctatcaccagctcctccggaagatttgtcaggctgggaacggtaaattctatc

SEQ ID NO: 10759 - DNA, 201 bp, Artificial Sequence
  Synthetic polynucleotide
gtttggcatcttcctctacatgggggtcacgtcgctcagcggcatccagctctttgaccgcatcttgcttctgttcaagccacccaagtatcacccagatgtgccctacgtcaagcgggtacaggacccttttctggctgcccagcctggggtggtagagggtgctggggtgtgataggcactgaccccagcctccgcctg

SEQ ID NO: 10760 - DNA, 201 bp, Artificial Sequence; identical to SEQ ID NO: 10735
  Synthetic polynucleotide

SEQ ID NO: 10761 - DNA, 201 bp, Artificial Sequence
  Synthetic polynucleotide
cagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgcc

SEQ ID NO: 10762 - DNA, 201 bp, Artificial Sequence
  Synthetic polynucleotide
gtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaa

SEQ ID NO: 10763 - DNA, 212 bp, Artificial Sequence
  Synthetic polynucleotide
gattagagcccacctggaaacccttcatcctcacgcagttctctcgccacacagcaacactgctttccccactcaaccagagccggtgcctgacttacctcacggtgggcctcgctggagattttattggtatagcgcagaacctccagctccatatccgtcttaaacactcggcttcagagacagaagaacaaagcagcaaatcagtgact

SEQ ID NO: 10764 - DNA, 201 bp, Artificial Sequence
  Synthetic polynucleotide
gtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccg

SEQ ID NO: 10765 - DNA, 201 bp, Artificial Sequence; identical to SEQ ID NO: 10732
  Synthetic polynucleotide

SEQ ID NO: 10766 - DNA, 201 bp, Artificial Sequence
  Synthetic polynucleotide
aggggcatccccatcgagcgagtcgtctcctcggagggtggccggccctctgtggacctctccttccagccctcgcagcccctgagcaagtccagctcctctcccgagctgcagactctgcaggacatcctcggggaccctggggacaaggccgacgtgggccggctgagccctgaggttaaggcccggtcacagtcaggg

SEQ ID NO: 10767 - DNA, 201 bp, Artificial Sequence
  Synthetic polynucleotide
tcttttctattctttcgttttataggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccgg

SEQ ID NO: 10768 - DNA, 201 bp, Artificial Sequence
  Synthetic polynucleotide
ttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctg

SEQ ID NO: 10769 - DNA, 207 bp, Artificial Sequence
  Synthetic polynucleotide
tgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccac

SEQ ID NO: 10770 - DNA, 201 bp, Artificial Sequence
  Synthetic polynucleotide
actaactacgtctgttgtctggtcagctctttgacaaaattgccatcctgagcttcggagagctgattttctgtggcacgccagcggaaatgcttgatttcttcaatgactgcggttacccttgtcctgaacattcaaacccttttgacttctatagtaagtttttctttcacattccccatcatgaatgttttttaaact

SEQ ID NO: 10771 - DNA, 201 bp, Artificial Sequence
  Synthetic polynucleotide
catggaagggtgaggccttgaggttgaggtgggggtgttggctgggggagctgccatgtatgcagttaccagaacgtggcgctggctttgcttccagggagtgtgtggggaagacggtgacattgcagggcaacctggacccctgtgccttgtatgcatctgaggtaacagccagggcccctctgtgtgtctgttactgtg

SEQ ID NO: 10772 - DNA, 201 bp, Artificial Sequence; identical to SEQ ID NO: 10714
  Synthetic polynucleotide

SEQ ID NO: 10773 - DNA, 201 bp, Artificial Sequence
  Synthetic polynucleotide
caggcggcacagggcgggcagctcttcgattacatccaggcagtctctagctacctggcaccgcccgtgtccgccgtcttcgtgctggcgctcttcgtgccgcgcgttaatgagcaggtgagcggcacgcgcgtggtgacggcagggctgggcttgcacatcctcagcaggctgacctgtttccttcgcagggcgccttct

SEQ ID NO: 10774 - DNA, 213 bp, Artificial Sequence
  Synthetic polynucleotide
gcacgcaccctcctcgtaaggcgtgtactccactttgtacatgccatcgccacggtcctgaacgtaggtctccgtcaggttgcctgaggggttggccacacgggccttgacgtgcggccctccggtctgtgtcagagcccgggcgtccacactgaactcagtggtggcctcacggaagacacctgcaaaggcacagagaggaggcttggggct

SEQ ID NO: 10775 - DNA, 201 bp, Artificial Sequence
  Synthetic polynucleotide
ggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgt

SEQ ID NO: 10776 - DNA, 201 bp, Artificial Sequence
  Synthetic polynucleotide
cctggccccggcctggggctctgtgtgtttcagcactctacccagaccctcccggccccagggtccacacgtgctcggccgcaggaggcttcagcaccagcgattacgacgttggctgggagagtcctcacaatggctcggggacgtgggcctattcagcgccggatctgctggggtgagcagagcgagggccccgggcgt

SEQ ID NO: 10777 - DNA, 201 bp, Artificial Sequence; identical to SEQ ID NO: 10731
  Synthetic polynucleotide

SEQ ID NO: 10778 - DNA, 201 bp, Artificial Sequence; identical to SEQ ID NO: 10730
  Synthetic polynucleotide

SEQ ID NO: 10779 - DNA, 201 bp, Artificial Sequence; identical to SEQ ID NO: 10723
  Synthetic polynucleotide

SEQ ID NO: 10780 - DNA, 201 bp, Artificial Sequence
  Synthetic polynucleotide
ccaccttgcctgccccctggatcccaggtttgggagaggggcaggagtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaa

SEQ ID NO: 10781 - DNA, 201 bp, Artificial Sequence
  Synthetic polynucleotide
cctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcaga

SEQ ID NO: 10782 - DNA, 201 bp, Artificial Sequence
  Synthetic polynucleotide
gtgcctgcttcgcttggcggccttcgcgcacgacgccagcccggccgcccgcgcccagctcttctccgcgctgcacggctatctgcgccccaaaccgccccggcccaagccggtagatccgaggcctccagcgccgcgcccatccctggaccccgccgcaccggcccttggccctgcgctgcaccagcgccccccagtgca

SEQ ID NO: 10783 - DNA, 201 bp, Artificial Sequence
  Synthetic polynucleotide
aatataactagtaaaagaagttttgtttatttttaaacagaattagttttaacaacattggacttccaaaaggctctccgcggatttcttcctgcgtctttgcgaagtgtcaacctgcataaacctagagacctgggttgggacaagattggtgggttacatgaagttaggcagatactcatggatactatccagttacct

SEQ ID NO: 10784 - DNA, 201 bp, Artificial Sequence
  Synthetic polynucleotide
taggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataac

SEQ ID NO: 10785 - DNA, 201 bp, Artificial Sequence
  Synthetic polynucleotide
acagctccagacactcaggcattgggcacggacaagcttcatctgcagtcagagacagtggacaccgagggtacagtggtagtcaggccagtgacaatgagggacattcagaagactcagacacacagtcagtgtcagcccacggacaggctgggtcccatcagcagagccaccaagagtccgcacgtggccggtcagggg

SEQ ID NO: 10786 - DNA, 201 bp, Artificial Sequence
  Synthetic polynucleotide
gcctctaactccagcccccttcagcatctccggctacgacatccctgagggcacagtcatcattccgaacctccaaggcgcccacctggatgagacggtctgggagaggccacatgagttctggcctggtatgtggggggccgggggcctgccgtgaaaatgtggtggaggctggtccccgctgccgctgaacgcctcccc

SEQ ID NO: 10787 - DNA, 201 bp, Artificial Sequence
  Synthetic polynucleotide
gtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcga

SEQ ID NO: 10788 - DNA, 201 bp, Artificial Sequence
  Synthetic polynucleotide
gcaatgtcttcttttttgaaaggatataattgacactggcaaaacaatgcagactttgctttccttggtcaggcagtataatccaaagatggtcaaggtcgcaaggtatgtatgacattttgacacagaatattttcctcatttgaagggggattaagtgattgcttctttttaaggataaatgttttcaactgtcatttt

SEQ ID NO: 10789 - DNA, 201 bp, Artificial Sequence
  Synthetic polynucleotide
agctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaac

SEQ ID NO: 10790 - DNA, 201 bp, Artificial Sequence
  Synthetic polynucleotide
gccttgtcagtgcttgattacatactctgtctccttccgttaattttagaatgagagcgctcgctgtgctgtctgtcacgctggttatggcctgcacagaagccttcttccccttcatctcgagagggaaagaactcctttggggtaagtagcaaacacattgcggtcttctggccttataaagttatttttcacacttac

SEQ ID NO: 10791 - DNA, 201 bp, Artificial Sequence
  Synthetic polynucleotide
accccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctg

SEQ ID NO: 10792 - DNA, 207 bp, Artificial Sequence
  Synthetic polynucleotide
agctattctctgtcctcccaccagcttcatgtactggactgactggggaactcccgccaagatcaagaaagggggcctgaatggtgtggacatctactcgctggtgactgaaaacattcagtggcccaatggcatcaccctaggtatgttcgcaggacagccgtcccagccagggccgggcacaggctggaggacagacgggggttg

SEQ ID NO: 10793 - DNA, 201 bp, Artificial Sequence
  Synthetic polynucleotide
tctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcgtgagtcctgcgttcgaccccaccccgtcccagccggggaccccggcccctcctgagcgtcac

SEQ ID NO: 10794 - DNA, 201 bp, Artificial Sequence
  Synthetic polynucleotide
aggaggacattgaaagcaacctgctccggcccacaggcgtagccctgcgaggagcccacttctgcctgaaggtcttccgggccgaggacttgccgcagagtgcgtggggcgcgcccttgggtgggaggtctgcaggaggctggaggcgcagggctggtgggggtgggcgatggcgggcggggtcagctccctgggggaagg

SEQ ID NO: 10795 - DNA, 201 bp, Artificial Sequence
  Synthetic polynucleotide
aatgatgtttttcaggccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacaggtttgcttggaaatcttatttacagttatttaaa

SEQ ID NO: 10796 - DNA, 214 bp, Artificial Sequence; identical to SEQ ID NO: 10733
  Synthetic polynucleotide

SEQ ID NO: 10797 - DNA, 208 bp, Artificial Sequence
  Synthetic polynucleotide
gaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatct

SEQ ID NO: 10798 - DNA, 201 bp, Artificial Sequence
  Synthetic polynucleotide
cttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaatggag

SEQ ID NO: 10799 - DNA, 201 bp, Artificial Sequence
  Synthetic polynucleotide
gggctcttctggccccagggtctctcaccctgtctctctcctgtccctcccctccagctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagc

SEQ ID NO: 10800 - DNA, 213 bp, Artificial Sequence
  Synthetic polynucleotide
gtaggtttctgctgtgcctgactggcatttggttgtacttttttttctttatctcttcactgctagaacaactatcaatttgcaattcagtacaattaggtgggcttagatttctactgactactagttcaagcgcatgaatatgcctggtagaagacttcctcctcagcctattctttttaggtgcttttgaattgtggatatttaattcga

SEQ ID NO: 10801 - DNA, 201 bp, Artificial Sequence; identical to SEQ ID NO: 10798
  Synthetic polynucleotide

SEQ ID NO: 10802 - DNA, 201 bp, Artificial Sequence
  Synthetic polynucleotide
ccgccgcgggaggagcccggactcgggccgaggctgcccaggcaatgcgttcactcggcgcaaacatggctgcggccctgcgcgccgcgggcgtcctgctccgcgatccgcgtaagtgggtctgtcgcggcggccgccagggccaggatccctgagaaggcgtgggcagagcgggcagctggcgcccgggccctcgcgccc

SEQ ID NO: 10803 - DNA, 201 bp, Artificial Sequence; identical to SEQ ID NO: 10761
  Synthetic polynucleotide

SEQ ID NO: 10804 - DNA, 207 bp, Artificial Sequence
  Synthetic polynucleotide
cgcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcg

SEQ ID NO: 10805 - DNA, 201 bp, Artificial Sequence; identical to SEQ ID NO: 10724
  Synthetic polynucleotide

SEQ ID NO: 10806 - DNA, 211 bp, Artificial Sequence
  Synthetic polynucleotide
ttgcgttctctccttgtgccctgccgtgagccaggcctttcttaattaccttgggggagtcactggtcactgttacccggaagaggtacatggacactgtcatgccagccatcatgaacagcaacaggccatggcgagggttcccgtagttggacagtcccgcctatggatacagtcccggcaatgtcacgtcctcagaacagggcagaga

SEQ ID NO: 10807 - DNA, 201 bp, Artificial Sequence
  Synthetic polynucleotide
gctacctggagatcagcctgcggctgcaccgcttgctgcgcgacagcgaggccttctgccaccgcaactgcagcgccgcgccgcagcccgagcccgccgccggcctcgccagctatcccgagctgcgcctcttcgggggcctgctgcgccgcgcgcactgcctcaagcgctgcaagcagggcctgccagccttccgccagt

SEQ ID NO: 10808 - DNA, 207 bp, Artificial Sequence
  Synthetic polynucleotide
tatagtctttctctcctctagcaaccttggaattcagagtcctactcacctgcgtagtgataaatattggttgtgaggccacaggggaactagtcacatgattggcattctgcatgacctgaacaggcctcaatactggttgagtaaccattgtgcccagacctggggctggattctgggtcaggatgagtggctgtccaccttgct

SEQ ID NO: 10809 - DNA, 201 bp, Artificial Sequence
  Synthetic polynucleotide
tggggctctaggcagtttgtctggggtgggacttggcatccctgcgccctgtgactctctgcccctgcgccccagggagcgcgggggcttctttagcccggaacccggtgagcccgacagcccctggacgggctcaggtggcaccacgccctccacccccacaacccccaccacggagggtgagggcgacggactctccta

SEQ ID NO: 10810 - DNA, 201 bp, Artificial Sequence; identical to SEQ ID NO: 10771
  Synthetic polynucleotide

SEQ ID NO: 10811 - DNA, 201 bp, Artificial Sequence
  Synthetic polynucleotide
gtggcctaccggagacatgagaagaagaggaagttcatcaagggggagataaagagtgaatttaaggacatcgaggagatcaaaacccagaaggtccgcatcgaaggctccctgtggtggacctacacaagcagcatcttcttccgggtcatcttcgaagccgccttcatgtacgtcttctatgtcatgtacgacggcttc

SEQ ID NO: 10812 - DNA, 201 bp, Artificial Sequence
  Synthetic polynucleotide
atggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggc

SEQ ID NO: 10813 - DNA, 201 bp, Artificial Sequence
  Synthetic polynucleotide
gaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaaca

SEQ ID NO: 10814 - DNA, 201 bp, Artificial Sequence
  Synthetic polynucleotide
gtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaaggc

SEQ ID NO: 10815 - DNA, 201 bp, Artificial Sequence
  Synthetic polynucleotide
tcagagcgtctggtgagatgctgttgccgctgctgctgctgctacccatgtgctgggccgtggaggtcaagaggccccggggcgtctccctcaccagtgagtcctcctgttcaccctcccgccaggctggaggtgggaggggccaacattgggccttagggataggcatttacagccttttgactcagtttcccggtagtg

SEQ ID NO: 10816 - DNA, 201 bp, Artificial Sequence
  Synthetic polynucleotide
ctgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgaggtgaggaaagagtcaggggatccagccctgctgaggggaag

SEQ ID NO: 10817 - DNA, 201 bp, Artificial Sequence; identical to SEQ ID NO: 10750
  Synthetic polynucleotide

SEQ ID NO: 10818 - DNA, 201 bp, Artificial Sequence
  Synthetic polynucleotide
ttatacgtagtaggtgctcagtagatgttgcatgcatccatgattagtcccttggtcacaaactgttgtgctttttcctagtactccacccacctgcaccttgctgaggactgtatgaagcattaccaaggcaccgtagacaaactctgccgagtggagcaggtaggactctccttctgccacggcaagtttttgccaggc

SEQ ID NO: 10819 - DNA, 201 bp, Artificial Sequence
  Synthetic polynucleotide
ttctagtacctaaggaaattcagaaaagagcaatgcatcaaccaataaccattttttcttatttcattacagagaagaggtgaagagtccagtgaaatggagcaaatttcaatcattgaaaggttcccttatcccttccaggtgagttattttctctcaccaaatctcgaaaggcccctgtaacacaattagaaggggtgg

SEQ ID NO: 10820 - DNA, 201 bp, Artificial Sequence
  Synthetic polynucleotide
gcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtga

SEQ ID NO: 10821 - DNA, 201 bp, Artificial Sequence
  Synthetic polynucleotide
ctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcaggtaaattgttggtaacatttattgtgctttcctgattattaatgctatatga

SEQ ID NO: 10822 - DNA, 201 bp, Artificial Sequence
  Synthetic polynucleotide
aaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggtaggtattcttgactattttcttaatttatttatcggttatatatagtagagg

SEQ ID NO: 10823 - DNA, 201 bp, Artificial Sequence
  Synthetic polynucleotide
gcctggtccaataccaggtggggctcttcctgtccactcccagcctcccactgtcccaccgcctcctgcctctctcctctctccccagaacatccagagtctgtcccctgtgaagaagaagaagatggtgcctggggctctgggggtccccgctgacctggcccctgttgacgtcgagttctcctttcccaagttctcccg

SEQ ID NO: 10824 - DNA, 201 bp, Artificial Sequence
  Synthetic polynucleotide
ctgaccatccagaagggcagtgggcggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctc

SEQ ID NO: 10825 - DNA, 201 bp, Artificial Sequence
  Synthetic polynucleotide
tacagttgatatagaagatcatgagtgtgctgtgtggctgctcctacggaagagcaagtcagatgacaaaaccacgcgactcgaggctgtgcgggaaatgtcggagacccatcactggcatggtaatgagactacctgaacaggtggcatgccttcagctggctcttgattgctgacataaaagacaagggagtggccagg

SEQ ID NO: 10826 - DNA, 201 bp, Artificial Sequence
  Synthetic polynucleotide
gagtttgctgaagaggaagatgttacccagggcagccttgctggtcaccacgcggcccagggcactgagggacctccagctcctggcgcagcagccgatctacgtaagggtggagggcttcctggaggaggacaggagggcctatttcctgagacactttggagacgaggaccaagccatgcgtgcctttgagctaatgag

SEQ ID NO: 10827 - DNA, 201 bp, Artificial Sequence
  Synthetic polynucleotide
ccgaccttggcccgcggccgccggtgagcctagacccgcgcgtctccatctacagcacgcgccgcccggtgttggcgcgcacccacgtccagggccgcgtctacaacttcctcgagcgtcccaccggctggaaatgcttcgtttaccacttcgccgtgtgagtatcgccaccggcgacggccggcacgaaggtgcttcctg

SEQ ID NO: 10828 - DNA, 201 bp, Artificial Sequence
  Synthetic polynucleotide
gctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggtatgggcctggggacctgggacacagggtgtaggaggggcagataggaactgcagaatcag

SEQ ID NO: 10829 - DNA, 201 bp, Artificial Sequence
  Synthetic polynucleotide
ccccccgcagaaacgtctacaaggacctgcggcagatcgagctggcctgtgactcccaggaagacgtggacagctggaaggcctcgttcctccgagctggcgtctaccccgagaaggaccaggtgaggagccgtcctgcgcagccaggcccagagcccccacctgggagaggaagcagggctggctttccccaggacaggt

SEQ ID NO: 10830 - DNA, 201 bp, Artificial Sequence
  Synthetic polynucleotide
acacacttctctctgtgcctttagaagtcggggacttcctctccctggacctgggtggcactaacttcagggtgatgctggtgaaggtgggagaaggtgaggaggggcagtggagcgtgaagaccaaacaccagatgtactccatccccgaggacgccatgaccggcactgctgagatggtgagcagcgcaggggccgggg

SEQ ID NO: 10831 - DNA, 201 bp, Artificial Sequence
  Synthetic polynucleotide
acggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatga

SEQ ID NO: 10832 - DNA, 201 bp, Artificial Sequence
  Synthetic polynucleotide
cagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaaggtatgtggggtgtttcagccgaagtgaggcactagaaaac

SEQ ID NO: 10833 - DNA, 201 bp, Artificial Sequence
  Synthetic polynucleotide
atattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatg

SEQ ID NO: 10834 - DNA, 201 bp, Artificial Sequence
  Synthetic polynucleotide
gccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagtgagagccactccccagtggaccca

SEQ ID NO: 10835 - DNA, 201 bp, Artificial Sequence; identical to SEQ ID NO: 10731
  Synthetic polynucleotide

SEQ ID NO: 10836 - DNA, 201 bp, Artificial Sequence
  Synthetic polynucleotide
gctcacattccgtctctctggggaacacttttagagcctacatggaggacgcgcccctgctgagaggagccgtgttttttgtgggcatggctctctggggagcccaccggctctattctctcaggaactcgccgacatctgtgttgccatcattttaccaggtaaggcggtttctgtgtgcagtgagctggcaggaacggg

SEQ ID NO: 10837 - DNA, 201 bp, Artificial Sequence; identical to SEQ ID NO: 10751
  Synthetic polynucleotide

SEQ ID NO: 10838 - DNA, 201 bp, Artificial Sequence
  Synthetic polynucleotide
ggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggc

SEQ ID NO: 10839 - DNA, 201 bp, Artificial Sequence
  Synthetic polynucleotide
cgtcactgtgaaggtcagcatgtgcccagatttttgctttgagaatataaaaaaaacttttattttctgttccagaactttccatgactggatcacagggaaaaaccgaccgagctcaggaagcctaatccaggtggtaaccacagaaggaaggacggaactcaccccagcatatttttaggcctcatctcagtgcctatg

SEQ ID NO: 10840 - DNA, 209 bp, Artificial Sequence
  Synthetic polynucleotide
cttttattacagaattcagccttttctacattcattctgtctttagtgagtaataaactgctgttctcatgctgtaatgagctggcatgagtatttgtgccacatggctccacatgcaagtttgaaacagaactaccctgatacttttctggatgcctctcagctgcacgcttctcagtggtgttcaaatcattattactgggttgatg

SEQ ID NO: 10841 - DNA, 201 bp, Artificial Sequence; identical to SEQ ID NO: 10818
  Synthetic polynucleotide

SEQ ID NO: 10842 - DNA, 201 bp, Artificial Sequence
  Synthetic polynucleotide
ttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatca

SEQ ID NO: 10843 - DNA, 201 bp, Artificial Sequence
  Synthetic polynucleotide
gcagagcgggcttgccttctccctcaggtggccaaagtggagaagttcaaacacactcagagcaccaaggacagcctgcacgccaagtacaacaccgccacctgtggcacggtggtgggcgacgaccagtggggccacctccaggtggatgccacctctctcttcctcctgttcctggcccagatgaccgcctcaggtgag

SEQ ID NO: 10844 - DNA, 201 bp, Artificial Sequence
  Synthetic polynucleotide
tggggaactcccgccaagatcaagaaagggggcctgaatggtgtggacatctactcgctggtgactgaaaacattcagtggcccaatggcatcaccctaggtatgttcgcaggacagccgtcccagccagggccgggcacaggctggaggacagacgggggttgccaggtggctctgggacaagcccaagctgctccctga

SEQ ID NO: 10845 - DNA, 201 bp, Artificial Sequence
  Synthetic polynucleotide
cccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggag

SEQ ID NO: 10846 - DNA, 201 bp, Artificial Sequence
  Synthetic polynucleotide
caaaccctacaacagcagcggcctgggcggcccctccatcaaggacaagtatgtgacggcgctctacttcaccttcagcagcctcaccagtgtgggcttcggcaacgtctctcccaacaccaactcagagaagatcttctccatctgcgtcatgctcattggctgtgagtgtgcccaggggcgggcggcggggagagccca

SEQ ID NO: 10847 - DNA, 209 bp, Artificial Sequence
  Synthetic polynucleotide
gcactggggggcgctggtgcagcgcagggccaagggccggtgcggcggggtccagggatgggcgcggcgctggaggcctcggatctaccggcttgggccggggcggtttggggcgcagatagccgtgcagcgcggagaagagctgggcgcgggcggccgggctggcgtcgtgcgcgaaggccgccaagcgaagcaggcactcgcggaaa

SEQ ID NO: 10848 - DNA, 201 bp, Artificial Sequence
  Synthetic polynucleotide
agggggttgcctgtacctcggggagcccaagccccttttgagggcactgacgctcacgccccccgggtcttccaacacctgcagccaacatggcagcagccttcggaggcttcctctacttcttcacctacatcccctacttcttcgtggcccctcggtacaactggatgactctgagccagaagctctgctcctgcctcc

SEQ ID NO: 10849 - DNA, 200 bp, Artificial Sequence
  Synthetic polynucleotide
ccgcccctggccggcaccagcggtcagcccgcagcctcgaggcaagcagccctgcccctggcactatccgcccgcggggacggccactcaccgatgacggcattggcgatggtgatcttgagccacatgcggtcgcggatctccagtcccgagtctggcagctgcatgacccggacgacggcgctcatgtcactcttcac

SEQ ID NO: 10850 - DNA, 201 bp, Artificial Sequence
  Synthetic polynucleotide
gcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacct

SEQ ID NO: 10851 - DNA, 212 bp, Artificial Sequence; identical to SEQ ID NO: 10763
  Synthetic polynucleotide

SEQ ID NO: 10852 - DNA, 201 bp, Artificial Sequence
  Synthetic polynucleotide
cagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttggga

SEQ ID NO: 10853 - DNA, 208 bp, Artificial Sequence
  Synthetic polynucleotide
cagagcaaagtacagagtcaagagttccaaagccacagaccccagacccccccaggccaaagagaagctgcacttacggaggcaccagcaggcccaggggacccaggagtaccaggttcaccgcgaggaccttgagcaccttcaggaccacgggcaccagtggggccggcttcaccctgggaagagacagggaggatgaaatgaagaa

SEQ ID NO: 10854 - DNA, 201 bp, Artificial Sequence
  Synthetic polynucleotide
gcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgaga

SEQ ID NO: 10855 - DNA, 210 bp, Artificial Sequence
  Synthetic polynucleotide
gaagaagagggctctgggcagcctgtggctggagaagttacctcggatcctttagccagagcaaatccgccccctagtagcagcacgatgccccagggcactttctcctgggttaccttccaatccagcaggggagggggataaaatggagttttcctttctgggaagaaaaagaaacacacacacacacacacacacacacacacacac

SEQ ID NO: 10856 - DNA, 201 bp, Artificial Sequence
  Synthetic polynucleotide
ggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccg

SEQ ID NO: 10857 - DNA, 201 bp, Artificial Sequence
  Synthetic polynucleotide
tgcctgccaggggggaggctcctaaggcccaccccggtgttttccccgccagctgccttctgccagagcctgggcgccgccgcccccgaggtccgctgctgtgtggatgccgtgaacttcgtggccgagagcacgagagatcaggaggccaccggcgaggtgggacaggagccagaggcgggtggagcgaggcagaggccc

SEQ ID NO: 10858 - DNA, 201 bp, Artificial Sequence
  Synthetic polynucleotide
ctcgtgctcaggctgctccaggcatgtgggaagctgaagcggcagctctgcgccatctaccggctgaactttctgaccacagcccccagcaggggaggcccacacctgccccagcacctgcaggaccaagtgcagaggctcatgcggtaagtgcagtgcggccccctgggtggccagggcagggtctggggcccgtacttc

SEQ ID NO: 10859 - DNA, 201 bp, Artificial Sequence
  Synthetic polynucleotide
ctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggca

SEQ ID NO: 10860 - DNA, 201 bp, Artificial Sequence
  Synthetic polynucleotide
ccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtg

SEQ ID NO: 10861 - DNA, 201 bp, Artificial Sequence
  Synthetic polynucleotide
ccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaa

SEQ ID NO: 10862 - DNA, 201 bp, Artificial Sequence
  Synthetic polynucleotide
cagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcgg

SEQ ID NO: 10863 - DNA, 206 bp, Artificial Sequence
  Synthetic polynucleotide
ccaccctgagcaatggcggctgccagtatctgtgcctccctgccccgcagatcaacccccactcgcccaagtttacctgcgcctgcccggacggcatgctgctggccagggacatgaggagctgcctcacaggtgtggcacacgccttgtttctgcgtcctgtgtcctccaactgccccctcctgagcctctctctgctcatctgt

SEQ ID NO: 10864 - DNA, 201 bp, Artificial Sequence
  Synthetic polynucleotide
catcccccgggctcaggaggctgctctgctcccccaggtcttcacctcagacactgaggcctccagtgagtccgggcttcacacgccggcatctcaggccaccaccctccacgtccccagccaggaccctgccagcatccagcacctgcagccggcccaccggctcagcgccagccccacaggtgagaggccctggctcca

SEQ ID NO: 10865 - DNA, 213 bp, Artificial Sequence
  Synthetic polynucleotide
ttccctccccatagttaccgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgggtggccacagagtttgtgtgggttcctccaagc

SEQ ID NO: 10866 - DNA, 201 bp, Artificial Sequence
  Synthetic polynucleotide
tttgttatatataaatattagtttatatgttcataattattttcaacgtatattacagagtattaaagaatctgaagaggaactatattgtgcctattctttggcttaatgaggtttgtatttgcagctgttagtcattaaaaacaaccttctttgtatataaacaagctcttgatgtttcaaaagaatgtatagtattta

SEQ ID NO: 10867 - DNA, 201 bp, Artificial Sequence
  Synthetic polynucleotide
gagctggctctgctgcagcagcctgaggaccagcctgactctgccctcccagaaatcctgcagtttaacctgctgggggtgcctctggtcggggccgacgtctgcggcttcctgggcaacacctcagaggagctgtgtgtgcgctggacccagctgggggccttctaccccttcatgcggaaccacaacagcctgctcagt

SEQ ID NO: 10868 - DNA, 209 bp, Artificial Sequence
  Synthetic polynucleotide
tgggatacatactactgaatgcaaaggacaccacacacacgcatgtgcacacacacacacgctttttacctgagtggttaaaatgtcactctgagaggatagccctgagcagtcttcagagacgcttgtttcactctcacacccagatgctgcttcaccttaaataacaaaaacagaggttcagatgtaaaagcagactataaacgctg

SEQ ID NO: 10869 - DNA, 200 bp, Artificial Sequence
  Synthetic polynucleotide
tgccaatctcatcttgttttctgcgcaagttaggttttgtcaagaaagggtgtaacgcaactaagtcatagtccgcctagaagcatttgcggtggacgatggaggggccggactcgtcatactcctgcttgctgatccacatctgctggaaggtggacagcgaggccaggatggagccgccgatccacacggagtacttg

SEQ ID NO: 10870 - DNA, 201 bp, Artificial Sequence; identical to SEQ ID NO: 10793
  Synthetic polynucleotide

SEQ ID NO: 10871 - DNA, 201 bp, Artificial Sequence
  Synthetic polynucleotide
agaaaaaaagaatgacaaggttcacttttgatgatacggggtgttattaataagacatgtttcctttttggtactagggtgctcctggtgctgtaggtgcccctggtcctgctggagccacaggtgaccgggtaagcatgcattttcactaagccaacagcaatatctaaaatttcccgccttccctagtcccaaagagcc

SEQ ID NO: 10872 - DNA, 201 bp, Artificial Sequence
  Synthetic polynucleotide
cgaattcgtgctcaaggagggccagctgctgtgcaagggtgactacgagaaggagaaggacctgctcagctccgtgagccccgacgagtccgactccggtgaggcctggcctgagctgggggcaggcctcagggacgggggttgctggggtgtcctggaggggagtcccggctggagaagccacctcctgcttccaggacc

SEQ ID NO: 10873 - DNA, 201 bp, Artificial Sequence
  Synthetic polynucleotide
cggccagggtgcagtgtcaggacccccccggaagcctcctgggactgtcgctggcacagcccgaggccctgaaggtggcagcacggctcaggtgccagcacccacagcatcaccaccgccggagggtccagtgctcactttccagagtgagaagatgaagggcatgaaggagctgctggtggccaccaagatcaactcgag

SEQ ID NO: 10874 - DNA, 203 bp, Artificial Sequence
  Synthetic polynucleotide
ctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacag

SEQ ID NO: 10875 - DNA, 201 bp, Artificial Sequence
  Synthetic polynucleotide
ccacctccgtcctgaccactggccactccccttccacagaaccacgcctttcgcctgctgaagccggggggcgtcctcacctactgcaacctcacctcctggggggagctgatgaagtccaagtactcagacatcaccatcatgtttgaggtgcgcccacctgaagttccccatgggtctccaggaagtgaccttggatgg

SEQ ID NO: 10876 - DNA, 201 bp, Artificial Sequence
  Synthetic polynucleotide
gggcggggtgggggcccctgggctcccagggtgggagctggctccgaggctggctggctccgcaggtccgctgacgtcgccgcccagatggcctccaggctgaccctgctgaccctcctgctgctgctgctggctggggtatgtggtcccttgtgggatgggggacgggggtggagacgggaggcgggatggtgcggggtg

SEQ ID NO: 10877 - DNA, 201 bp, Artificial Sequence; identical to SEQ ID NO: 10723
  Synthetic polynucleotide

SEQ ID NO: 10878 - DNA, 207 bp, Artificial Sequence
  Synthetic polynucleotide
aatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctg

SEQ ID NO: 10879 - DNA, 201 bp, Artificial Sequence
  Synthetic polynucleotide
cgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttc

SEQ ID NO: 10880 - DNA, 206 bp, Artificial Sequence
  Synthetic polynucleotide
tctccagccccagctgctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcacagggcaggtcttggccagttggcaaaacatcttgttgagggcaggggagtac

SEQ ID NO: 10881 - DNA, 212 bp, Artificial Sequence
  Synthetic polynucleotide
gcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcct

SEQ ID NO: 10882 - DNA, 201 bp, Artificial Sequence
  Synthetic polynucleotide
tattctcattgcagtggtcttccaaatatttatgtcaatttcaccccaagctgtacctttgagggagaaaacactgtcatgatgctccagacggctaggtgagagtcaaatcctcgattcctcccatctgttcataagaatgttctagtccttttcctaggttcttgttcccatggtttttcttcaccgtatatatatatt

SEQ ID NO: 10883 - DNA, 201 bp, Artificial Sequence
  Synthetic polynucleotide
agcaatccagagcggccatcaacaaatgggtgtccaataagaccgaaggccgaatcaccgatgtcattccctcggaagccatcaatgagctcactgttctggtgctggttaacaccatttacttcaaggtactcagaatggccctggagagaccccagggacttcctcttgctcttcagcttaccccctttttttttaaat

SEQ ID NO: 10884 - DNA, 201 bp, Artificial Sequence
  Synthetic polynucleotide
caaaataatcgatcttgttagtaaacgtgatggaaacagctcgctgattgctgccgttgcagaagtaagagttcagaggcggcctctgaagaacagaacaggtaggtgtcaagtgggactagtttgtgtgatgatagtagatgatctcattatactattcaataaagccatcaggtcgagggattatctggcagtgcccta

SEQ ID NO: 10885 - DNA, 201 bp, Artificial Sequence
  Synthetic polynucleotide
agaatgagactctgtctcaaaaacaaacaaaaatttcttttcctaggaactaacaaaacattgtgtctttcttttgaagattatgtgatagaaaagctggagcaatgcgggttctttgacgacaacattagaaaggacacattctttttgacggtccatgatgctatactctatctacagaaccaagtgaaatctcaagag

SEQ ID NO: 10886 - DNA, 201 bp, Artificial Sequence; identical to SEQ ID NO: 10758
  Synthetic polynucleotide

SEQ ID NO: 10887 - DNA, 201 bp, Artificial Sequence
  Synthetic polynucleotide
gggagtctgggcttcaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcaggtgggactctgg

SEQ ID NO: 10888 - DNA, 201 bp, Artificial Sequence; identical to SEQ ID NO: 10749
  Synthetic polynucleotide

SEQ ID NO: 10889 - DNA, 201 bp, Artificial Sequence
  Synthetic polynucleotide
ttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaag

SEQ ID NO: 10890 - DNA, 201 bp, Artificial Sequence
  Synthetic polynucleotide
ctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaaca

SEQ ID NO: 10891 - DNA, 212 bp, Artificial Sequence
  Synthetic polynucleotide
tggtcaggtcgagggccaggcctcagagcggcccctgtgtccacgcaggtgtttggtcttgggaacaagacctacgagcacttcaatgccatgggcaagtacgtggacaagcggctggagcagctcggcgcccagcgcatctttgagctggggttgggcgacgacgatgggaagtgagtgcccaccctgccaccatgatcagcgcggcgggc

SEQ ID NO: 10892 - DNA, 200 bp, Artificial Sequence
  Synthetic polynucleotide
agctagggagcagggctgatgccagagctccgctaaaggctgctctctcaacaagaggaacgatttaagtcttggggcacgccctgccagctcaccttcctgcagccgcacctgccgcagccgtgggggccccagctctgggctggactggttcccgtggacgtagggcagcagcacgtgggccatccatggccagagct

SEQ ID NO: 10893 - DNA, 201 bp, Artificial Sequence; identical to SEQ ID NO: 10748
  Synthetic polynucleotide

SEQ ID NO: 10894 - DNA, 201 bp, Artificial Sequence; identical to SEQ ID NO: 10717
  Synthetic polynucleotide

SEQ ID NO: 10895 - DNA, 201 bp, Artificial Sequence
  Synthetic polynucleotide
catgaagcgcggcgcatgatcgagggcgtggtgtacgagatgcgcgtctacgcggtcaacgccatcggcatgtccaggcccagccctgcctcccagcccttcatgcctatcggtgagcctgcctggcctggtcctgccccccgccccctccccagttaaaaacctccaataatagcaggtgctctgcaggcagccatgcta

SEQ ID NO: 10896 - DNA, 201 bp, Artificial Sequence
  Synthetic polynucleotide
agattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttg

SEQ ID NO: 10897 - DNA, 201 bp, Artificial Sequence
  Synthetic polynucleotide
aagtggatacctttgggctgagcctctactttccctccaaaataactgcctccgctgtgacctttgatcaccagggaaatgtgattgttgcagatacatctggtccagctatcctttgcttaggaaaacctgaggagtttccagtaccgaagcccatggtcactcatggtctttcgcatcctgtggctcttaccttcacca

SEQ ID NO: 10898 - DNA, 201 bp, Artificial Sequence
  Synthetic polynucleotide
ttggcaggactttgaaatggatgtggtggcaatggtgaatgacacggtggccacgatgatctcctgctactacgaagaccatcagtgcgaggtcggcatgatcgtgggtaagggctccttgcacccctgccccttccagactgctgaggctccctgtgtacaacaggcttcaagggccctgtggggtgaggaccaaactac

SEQ ID NO: 10899 - DNA, 200 bp, Artificial Sequence; identical to SEQ ID NO: 10892
  Synthetic polynucleotide

SEQ ID NO: 10900 - DNA, 201 bp, Artificial Sequence; identical to SEQ ID NO: 10807
  Synthetic polynucleotide

SEQ ID NO: 10901 - DNA, 201 bp, Artificial Sequence
  Synthetic polynucleotide
tctccatacaggtcttctttggcaatgtggattcatctgggataaaacacaatatttttaaccctccaattattgctcgatacatccgtttgcacccaactcattatagcattcgcagcactcttcgcatggagttgatgggctgtgatttaaatagtaagtgccaagtcatcccatatccttcttccctcaaccatgggt

SEQ ID NO: 10902 - DNA, 201 bp, Artificial Sequence
  Synthetic polynucleotide
cagtcccctgcgcccaggcctagctactatgggcacccagcctgctacacaccaccccatccccacctacccctcctatgtgccggcggctgcccacgactacagcagcggactcttccaccccggaggcttcctggggggaccggcctccagcttcacccctaagcagcgcagcaaggctcgttcctgttcaggtaaagg

SEQ ID NO: 10903 - DNA, 201 bp, Artificial Sequence; identical to SEQ ID NO: 10713
  Synthetic polynucleotide

SEQ ID NO: 10904 - DNA, 209 bp, Artificial Sequence
  Synthetic polynucleotide
ccttttcccttccacctctttttggcttgtgctcctggcccctgagccctccccacaacctctgtcctccttaggttttcgtcatcgaggtgaagacaaaaggaggatccaagtacctcatctaccgccgctaccgccagttccatgctttgcagagcaagctggaggagcgcttcgggccagacagcaagagcagtgccctggcctgt

SEQ ID NO: 10905 - DNA, 201 bp, Artificial Sequence; identical to SEQ ID NO: 10839
  Synthetic polynucleotide

SEQ ID NO: 10906 - DNA, 209 bp, Artificial Sequence
  Synthetic polynucleotide
gttaggccacttcactgggtcatgattcacagaccactggttgacaaaaaccacagtgtccttgggaatgtggtagcccaagacagaggtgttggcagtggtggcatgaggaatagtgacaggcacaaagctggagaagcgcatggcttcataaaggaaggccaggacatagggcaggttgggctggtcacccatacaaggcagacggt

SEQ ID NO: 10907 - DNA, 201 bp, Artificial Sequence
  Synthetic polynucleotide
caatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttt

SEQ ID NO: 10908 - DNA, 201 bp, Artificial Sequence
  Synthetic polynucleotide
tgacccttccttcttgaccccatcgcaggcaggggtgtggggaagaacgaggaactgcgtctttatcaccatctcttcaacaactatgacccaggaagccggccagtgcgggagcctgaggatactgtcaccatcagcctcaaggtcaccctgacgaatctcatctcactggtaagctacccccaccctcatcttaagcca

SEQ ID NO: 10909 - DNA, 201 bp, Artificial Sequence
  Synthetic polynucleotide
gtgacctctcgtgtccccaggacacgctaggctcctggcagcgctgtgtgaccacgtgtgagacagccctgaagcaagggaaacgggtcgccatcgacaacacaaacccagacgccgcgagccgcgccaggtagcgtgaccgcggggccgtaggtggcctgcggcggggtgggcggggcctgcacatccagctccttcccc

SEQ ID NO: 10910 - DNA, 213 bp, Artificial Sequence; identical to SEQ ID NO: 10800
  Synthetic polynucleotide

SEQ ID NO: 10911 - DNA, 209 bp, Artificial Sequence; identical to SEQ ID NO: 10868
  Synthetic polynucleotide

SEQ ID NO: 10912 - DNA, 201 bp, Artificial Sequence; identical to SEQ ID NO: 10846
  Synthetic polynucleotide

SEQ ID NO: 10913 - DNA, 201 bp, Artificial Sequence
  Synthetic polynucleotide
tcctggagttccagccactggccggcaaccttgctctcaccttgctctccccactggcccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaaga

SEQ ID NO: 10914 - DNA, 201 bp, Artificial Sequence
  Synthetic polynucleotide
cccctttgactctgtggagccgcctaaaagacccaccagcagactcatcatgcacagcatggccatgttcggaagagagttctgctacgcggtggaggcagcgtatgtgaccccagtcctgctcagcgtaggtctgcccagcagcctgtacagcattgtgtggttcctcagccccatcctgggattcctgctgcagcccgt

SEQ ID NO: 10915 - DNA, 201 bp, Artificial Sequence
  Synthetic polynucleotide
caagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcct

SEQ ID NO: 10916 - DNA, 213 bp, Artificial Sequence
  Synthetic polynucleotide
ctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacat

SEQ ID NO: 10917 - DNA, 201 bp, Artificial Sequence
  Synthetic polynucleotide
tcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagcccagcccgtggtggtggcagccgacacgctcc

SEQ ID NO: 10918 - DNA, 201 bp, Artificial Sequence
  Synthetic polynucleotide
gaaatgtctctcttctattctaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctca

SEQ ID NO: 10919 - DNA, 201 bp, Artificial Sequence
  Synthetic polynucleotide
tgctgtctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggtgagacaagagcactgggggcctgcccacacacccacacctct

SEQ ID NO: 10920 - DNA, 201 bp, Artificial Sequence
  Synthetic polynucleotide
tcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcag

SEQ ID NO: 10921 - DNA, 201 bp, Artificial Sequence
  Synthetic polynucleotide
accctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgcc

SEQ ID NO: 10922 - DNA, 201 bp, Artificial Sequence
  Synthetic polynucleotide
tctgtctctttcagtcaggcctgggtctctcaagcttttgtgtctgtgcctgtctgagcccccatgggtgctgcctcttccccctgcaggagactactggattgaccccaaccaaggctgcaccttggacgccatgaaggttttctgcaacatggagactggcgagacttgcgtctaccccaatccagcaaacgttcccaa

SEQ ID NO: 10923 - DNA, 207 bp, Artificial Sequence; identical to SEQ ID NO: 10878
  Synthetic polynucleotide

SEQ ID NO: 10924 - DNA, 201 bp, Artificial Sequence
  Synthetic polynucleotide
acccgcccgcccgcccctatgaccaacatgagctggagcttcctgacgcggctgctggaggagatccacaaccactccaccttcgtgggcaaggtgtggctcacggtgctggtggtcttccgcatcgtgctgacggctgtgggcggcgaggccatctactcggacgagcaggccaagttcacttgcaacacgcggcagcca

SEQ ID NO: 10925 - DNA, 201 bp, Artificial Sequence
  Synthetic polynucleotide
tggtggccagcagcagctacaacatggtcatccgggaggacaaccagaccaaccgcctgcaggaggctctgaacctcttcaagagcatctggaacaacaggtttgtggagtgaccgcccaccccctgcgcttgcccaggaggccctggtctgcactgtttatagagaagaaccccgtgcaagcattccagacccctggccg

SEQ ID NO: 10926 - DNA, 201 bp, Artificial Sequence; identical to SEQ ID NO: 10876
  Synthetic polynucleotide

SEQ ID NO: 10927 - DNA, 201 bp, Artificial Sequence
  Synthetic polynucleotide
tctggcaccggaggtggcggcggcggcggcggggcgagcggcgggactagcggcagctgcagccccgcgtcctcggagccgccggctgcgcccgccgaccgcctgcgcgccgagagcccgtcgccgccgcgcctgctggccgcgcactgcgcgctgctgcccaagccgggcttcctgggcgcgggcggcggcggcggcggc

SEQ ID NO: 10928 - DNA, 201 bp, Artificial Sequence; identical to SEQ ID NO: 10727
  Synthetic polynucleotide

SEQ ID NO: 10929 - DNA, 201 bp, Artificial Sequence; identical to SEQ ID NO: 10761
  Synthetic polynucleotide

SEQ ID NO: 10930 - DNA, 201 bp, Artificial Sequence; identical to SEQ ID NO: 10909
  Synthetic polynucleotide

SEQ ID NO: 10931 - DNA, 201 bp, Artificial Sequence
  Synthetic polynucleotide
ttcaccggcctctcggggctccgccgactcttcctcaaggacaacggcctcgtgggcattgaggagcagagcctgtgggggctggcggagctgctggagctcgacctgacctccaaccagctcacgcacctgccccaccgcctcttccagggcctgggcaagctggagtacctgctgctctcccgcaaccgcctggcagag

SEQ ID NO: 10932 - DNA, 201 bp, Artificial Sequence
  Synthetic polynucleotide
catgcactggctgtccaccatcatccccacgcaccacatcaacgcgctcatcttcttcttcatcgtcagcaacctcaccatcgacttcttcgccttcttcatcccgctggtcatcttctacctgtccttcatctccatggtgatctgcaccctcaaggtgttccaggacagcaaggcctgggagaacttccgcaccctcac

SEQ ID NO: 10933 - DNA, 201 bp, Artificial Sequence
  Synthetic polynucleotide
ttgatgttgctacccatgttcccctgatattctatgttcctggaaggacggcttcacttccggaggcaggcgagaagcttttcccttacctcgacccttttgattccgcctcacagttgatggagccaggtataaaatatgctgaaatgatattgcttgacagtaagatcacctttagtttatatgtgaaccactttattg

SEQ ID NO: 10934 - DNA, 201 bp, Artificial Sequence
  Synthetic polynucleotide
ttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacatt

SEQ ID NO: 10935 - DNA, 201 bp, Artificial Sequence
  Synthetic polynucleotide
ggtggggggagctgacctagtggaagctgagcctcagtgtccccctccctcagccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgca

SEQ ID NO: 10936 - DNA, 201 bp, Artificial Sequence; identical to SEQ ID NO: 10717
  Synthetic polynucleotide

SEQ ID NO: 10937 - DNA, 201 bp, Artificial Sequence; identical to SEQ ID NO: 10879
  Synthetic polynucleotide

SEQ ID NO: 10938 - DNA, 201 bp, Artificial Sequence
  Synthetic polynucleotide
tctaacttttcattgtcctcaaagattaagattcttaaacatgttcctgaaggtgctgagacagagcaaggccttaaacgggagcttcaagttcttaggtacatcatgtattcatatgactactttgtttttttctttaaaaaaaaaattattagtttttatatactccgaattgctacaactagagacaagcatttttcg

SEQ ID NO: 10939 - DNA, 201 bp, Artificial Sequence; identical to SEQ ID NO: 10814
  Synthetic polynucleotide

SEQ ID NO: 10940 - DNA, 201 bp, Artificial Sequence
  Synthetic polynucleotide
cactacctgcagttggccggcgacacggatgaagaactcaacagctgcaccgctgtggactggctggtcctcgccgcgaagcagggccgtcgcgaggctgtgaagctgcttcgccggtgcttggcggacagaagaggtgggtctgtgtgaggcttagaacagcctctggagggttgagcagcttgtaatgctgcttgctaa

SEQ ID NO: 10941 - DNA, 201 bp, Artificial Sequence
  Synthetic polynucleotide
cccggcctggggctctgtgtgtttcagcactctacccagaccctcccggccccagggtccacacgtgctcggccgcaggaggcttcagcaccagcgattacgacgttggctgggagagtcctcacaatggctcggggacgtgggcctattcagcgccggatctgctggggtgagcagagcgagggccccgggcgtctacgc

SEQ ID NO: 10942 - DNA, 201 bp, Artificial Sequence
  Synthetic polynucleotide
ccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctc

SEQ ID NO: 10943 - DNA, 201 bp, Artificial Sequence
  Synthetic polynucleotide
ccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagc

SEQ ID NO: 10944 - DNA, 201 bp, Artificial Sequence
  Synthetic polynucleotide
tacttttccctccccatagttaccgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgggtggccacagagtttg

SEQ ID NO: 10945 - DNA, 201 bp, Artificial Sequence
  Synthetic polynucleotide
gggtggcttgcagcctggcccattttccctccccaggagtatggggcacccatcgtggaccccattaacgacatccgcatcattgccgtggtctcggtcactgtgctgctggccatctccctggctggcatggagtgggagtccaaggtgaggaggccatggaggagggggacatggaggtggtcacgtggagaagcgggg

SEQ ID NO: 10946 - DNA, 201 bp, Artificial Sequence; identical to SEQ ID NO: 10873
  Synthetic polynucleotide

SEQ ID NO: 10947 - DNA, 205 bp, Artificial Sequence
  Synthetic polynucleotide
cttcggccggttcaaggtgaacagcgaggaggaggaggaggacgcactgaccctgtcctcggccatgtggttctcctggggcgtcctgctcaactccggcatcggggaaggtaaggccccgcccggcccgcctggtcccgcctcggccctctagggtctgacagagccccccgcccgcccacaggcgcccccagaagcttctcag

SEQ ID NO: 10948 - DNA, 201 bp, Artificial Sequence; identical to SEQ ID NO: 10802
  Synthetic polynucleotide

SEQ ID NO: 10949 - DNA, 201 bp, Artificial Sequence
  Synthetic polynucleotide
gatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttct

SEQ ID NO: 10950 - DNA, 200 bp, Artificial Sequence; identical to SEQ ID NO: 10869
  Synthetic polynucleotide

SEQ ID NO: 10951 - DNA, 201 bp, Artificial Sequence
  Synthetic polynucleotide
catgatttcctgctggttccccgagagctgagtggctcctccccagtcctggaggagactcacccagctcaccagcagggagccagcagaccagggccccgggatgcccaggcacaccccggccgtcccagagcagtgcccacacagtgcgacgtcccccccaacagccgcttcgattgcgcccctgacaaggccatcacc

SEQ ID NO: 10952 - DNA, 201 bp, Artificial Sequence; identical to SEQ ID NO: 10802
  Synthetic polynucleotide

SEQ ID NO: 10953 - DNA, 201 bp, Artificial Sequence
  Synthetic polynucleotide
gccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgta

SEQ ID NO: 10954 - DNA, 210 bp, Artificial Sequence
  Synthetic polynucleotide
gcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaa

SEQ ID NO: 10955 - DNA, 201 bp, Artificial Sequence
  Synthetic polynucleotide
gttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaa

SEQ ID NO: 10956 - DNA, 201 bp, Artificial Sequence
  Synthetic polynucleotide
agttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtc

SEQ ID NO: 10957 - DNA, 201 bp, Artificial Sequence
  Synthetic polynucleotide
accatgagtgactgtctttagtcaaaaaccctccccacctgaagtagcactttcattaccctagagtcaccatcctggtaaatagagggttcgttcccaggaagaaagtgaatcctgaaacccggcagaaaggccaggtaagggacatggactcttcctactttagagaaggctctgggagtccaccaggctccatgcaat

SEQ ID NO: 10958 - DNA, 201 bp, Artificial Sequence
  Synthetic polynucleotide
gatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaac

SEQ ID NO: 10959 - DNA, 201 bp, Artificial Sequence
  Synthetic polynucleotide
ataattttttggcatgtttacccaggtacccagaagctattactgaccctgcctacaaaggacagattctcacaatggccaaccctattattgggaatggtggagctcctgatactactgctctggatgaactgggacttagcaaatatttggagtctaatggaatcaaggtagtaccagtggtggccatttaaaaagtct

SEQ ID NO: 10960 - DNA, 201 bp, Artificial Sequence; identical to SEQ ID NO: 10902
  Synthetic polynucleotide

SEQ ID NO: 10961 - DNA, 201 bp, Artificial Sequence; identical to SEQ ID NO: 10757
  Synthetic polynucleotide

SEQ ID NO: 10962 - DNA, 201 bp, Artificial Sequence
  Synthetic polynucleotide
ttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttt

SEQ ID NO: 10963 - DNA, 204 bp, Artificial Sequence
  Synthetic polynucleotide
ggcgataggccacggccatgtggtactggctcatggcccggtacttcaggctccagcctttgccatagttgttgacaagctctgccgccttgcaggggaagaacagggctttctcgtagtcctgcaggggacatggaatggaaggaggcaaactgagtggcagaggctgccccaagtcaagggctcctgggctaggtttctcta

SEQ ID NO: 10964 - DNA, 201 bp, Artificial Sequence
  Synthetic polynucleotide
cagggtcgtcagacaccaaaacatatttctgaaagtctaggagctgaggtggatcctgatatgtcttggtcaagttctttagctacaccacccacccttagttctactgtgctcataggtaataatagcaaatgtgtatttacaagaaagagcagatgaggttgataattgtcatctctaatacttctgttaaaaggaaat

SEQ ID NO: 10965 - DNA, 201 bp, Artificial Sequence
  Synthetic polynucleotide
gaccctcatgccaccccactgcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaaggt

SEQ ID NO: 10966 - DNA, 201 bp, Artificial Sequence
  Synthetic polynucleotide
aggagcttcaaggaggctttgcggggcagagctggggctgggtgcagcctgaggtgtccacctggccttcccaggccccctgctgccataccaagccgagttcctggtgcgcagccacgatgcggaggaggtgctgccctcaacacctgccagccgcttcctctcagccttggggggactctgggagcccggagagcttca

SEQ ID NO: 10967 - DNA, 201 bp, Artificial Sequence
  Synthetic polynucleotide
ccctaggagggacttcccaaccctgacaggcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcac

SEQ ID NO: 10968 - DNA, 201 bp, Artificial Sequence
  Synthetic polynucleotide
gctttggcccttggtgataggtggctcggcccgccctacctggcaccctgaccctggtcacggcctctccctccagcaggatacagacgtccctcaccagtgccagcttggggtctgcagatgagaactccgtggcccaggctgacgatagcctgaaaaacctccacctggagctcacggaaacctgtctggacatgatgg

SEQ ID NO: 10969 - DNA, 201 bp, Artificial Sequence; identical to SEQ ID NO: 10895
  Synthetic polynucleotide

SEQ ID NO: 10970 - DNA, 201 bp, Artificial Sequence
  Synthetic polynucleotide
aaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctgtg

SEQ ID NO: 10971 - DNA, 201 bp, Artificial Sequence
  Synthetic polynucleotide
acctcaagaaggccctgctcctccagggctccaacgagatcgagatccgcgccgagggcaacagccgcttcacctacagcgtcactgtcgatggctgcacggtgagtgcccagaatccccaggcagggccccacctctccggccttgggctttttggccaggccatagtgccctctctccatcactcccacgtggtaatgc

SEQ ID NO: 10972 - DNA, 201 bp, Artificial Sequence
  Synthetic polynucleotide
gtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcact

SEQ ID NO: 10973 - DNA, 201 bp, Artificial Sequence
  Synthetic polynucleotide
ggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaaggtattgctggcttttgtctctgcagctggttaaaagtagaggtgggtcaaacc

SEQ ID NO: 10974 - DNA, 204 bp, Artificial Sequence
  Synthetic polynucleotide
gacttagcatgttttcctttaacatttttctagaaaacagaatcttggcattgtcttcctcaagaaatggactcttcccaaaccttggatacatcccagactaggtttaatgtgagaacggaagatactgaagtgacagacttcccctctctggaggagggcatattgacgcaatcagaaaatcaagtaaaggaacccaacaga

SEQ ID NO: 10975 - DNA, 208 bp, Artificial Sequence
  Synthetic polynucleotide
cagagggcagaggcctagcaactgcccctccccctgcagcagtggtgcgactatcgcctgcgctgggatccgcgagactacgaaggcctgtgggtgctgagggtgccgtccaccatggtgtggcggccggatatcgtgctggagaacaagtgaggagggggtgcaggcaggggtgtgggggacaaaggacacagggtctgggcccagc

SEQ ID NO: 10976 - DNA, 201 bp, Artificial Sequence
  Synthetic polynucleotide
cccccaggcctgggggcagaatctgccataaccagcttcgtgtctccagggcggcgtgatggatgacaagagtgaagattccatgtccgtctccaccttgagcttcggtgtgaacagacccacgatttcctgcatattcgactgtaagtgaggcttcgaggcctctatggggtgataagggtgtgtcaccttatgcttctg

SEQ ID NO: 10977 - DNA, 201 bp, Artificial Sequence
  Synthetic polynucleotide
aaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttattt

SEQ ID NO: 10978 - DNA, 203 bp, Artificial Sequence
  Synthetic polynucleotide
ttattattagaaaaataatgagctcagtatttaccaagacagatccttcctgtggcatccaaagtcattccactgggacactgacacttgaatgaccccctagtgttaacacacaggccatttttacacactcctgggaacacttcacattcatctatatctaaaaagaaaaaaaaagtataaagttaatatatctttataat

SEQ ID NO: 10979 - DNA, 201 bp, Artificial Sequence; identical to SEQ ID NO: 10942
  Synthetic polynucleotide

SEQ ID NO: 10980 - DNA, 201 bp, Artificial Sequence
  Synthetic polynucleotide
cgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgggtggccacagagtttgtgtgggttcctccaagcccagaa

SEQ ID NO: 10981 - DNA, 201 bp, Artificial Sequence
  Synthetic polynucleotide
tcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgg

SEQ ID NO: 10982 - DNA, 209 bp, Artificial Sequence; identical to SEQ ID NO: 10904
  Synthetic polynucleotide

SEQ ID NO: 10983 - DNA, 201 bp, Artificial Sequence
  Synthetic polynucleotide
tttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagc

SEQ ID NO: 10984 - DNA, 201 bp, Artificial Sequence
  Synthetic polynucleotide
gagaagaatggaaataaccgaaagctgcgggtttgtgttgctacttgtaaccgtgcagattattctaaacttgccccgatcatgtttggcattaaaaccgaacctgagttctttgaacttgatgttgtggtacttggctctcacctgatagatgactatgggtaagatgaaagcattttcttattcttcattgcaacagtg

SEQ ID NO: 10985 - DNA, 201 bp, Artificial Sequence
  Synthetic polynucleotide
atgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaac

SEQ ID NO: 10986 - DNA, 201 bp, Artificial Sequence; identical to SEQ ID NO: 10714
  Synthetic polynucleotide

SEQ ID NO: 10987 - DNA, 201 bp, Artificial Sequence
  Synthetic polynucleotide
ggtttcgagtcaggggaggtcacaccggaccagatcacctgctctaacccggagcagtatgtgggctggtattcttcgtggactgcaaacaaggcccggctcaacagtcaaggctttgggtaagcagggcccggggattttttttcatgtgcttttaaaaaaaaataggcctctctaccagcgtggccaacacagtgaaac

SEQ ID NO: 10988 - DNA, 201 bp, Artificial Sequence
  Synthetic polynucleotide
tccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggcc

SEQ ID NO: 10989 - DNA, 201 bp, Artificial Sequence
  Synthetic polynucleotide
agagtgcagccgccgcccacccgacgccaggcctcgctccccgcctggcctgtccgcttcagtgttccatccgcgtctgtctccccgcaggccccggacggtgacggtgaaggtggaactgagctgcgcacccggggatctcgatgccgtcctcatcctgcagggtcccccctacgtgtcctggctcatcgacgccaacca

SEQ ID NO: 10990 - DNA, 201 bp, Artificial Sequence
  Synthetic polynucleotide
acagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcaggtgagggctgagccaatggggcagga

SEQ ID NO: 10991 - DNA, 201 bp, Artificial Sequence; identical to SEQ ID NO: 10791
  Synthetic polynucleotide

SEQ ID NO: 10992 - DNA, 201 bp, Artificial Sequence; identical to SEQ ID NO: 10809
  Synthetic polynucleotide

SEQ ID NO: 10993 - DNA, 201 bp, Artificial Sequence
  Synthetic polynucleotide
caggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccag

SEQ ID NO: 10994 - DNA, 201 bp, Artificial Sequence; identical to SEQ ID NO: 10832
  Synthetic polynucleotide

SEQ ID NO: 10995 - DNA, 201 bp, Artificial Sequence
  Synthetic polynucleotide
gtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtca

SEQ ID NO: 10996 - DNA, 201 bp, Artificial Sequence
  Synthetic polynucleotide
tctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcaccttt

SEQ ID NO: 10997 - DNA, 209 bp, Artificial Sequence
  Synthetic polynucleotide
tctctttgtcctgactgctcaaatcccatgttttcaggatttatcagtcttgtactaaggcatggaacttttagccattctgcagttttcatgggtatgtcctcatgcaccaaaatgattggttccacagaatcttcaagtaagtcattaaggtcatcaactttaatgtcacaataacagcattcgtgaattggcttcatgataagttt

SEQ ID NO: 10998 - DNA, 201 bp, Artificial Sequence
  Synthetic polynucleotide
tcgctgctatacactgacctgtctcataaaaagggggactctatagtctattgacgttttcttttccatgtgcagaaggaggcaatgtatatgcaactggtggaaataatgaaggacagttggggcttggtgacaccgaagaaagaaacacttttcatgtaattagcttttttacatccgagcataagattaagcagctgt

SEQ ID NO: 10999 - DNA, 201 bp, Artificial Sequence
  Synthetic polynucleotide
acgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatg

SEQ ID NO: 11000 - DNA, 201 bp, Artificial Sequence
  Synthetic polynucleotide
gaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaa

SEQ ID NO: 11001 - DNA, 201 bp, Artificial Sequence; identical to SEQ ID NO: 10854
  Synthetic polynucleotide

SEQ ID NO: 11002 - DNA, 201 bp, Artificial Sequence
  Synthetic polynucleotide
cagggccatgatgcctgttcctccccacacccctcgccctcctggctggcgccgccagattgaccaagtctccctcccgtcctcccccagaaaaaggtgcactgcctcaacatggacagcctctctttccagctgggcctctacctcagcccacacttcctccaggcctccaacaccatcgagccggggcagcagagcttt

SEQ ID NO: 11003 - DNA, 201 bp, Artificial Sequence
  Synthetic polynucleotide
ggtgcccattgtgtccttggagtgtgtgtcctgcaaggcacaggccgtgtacgaagtgagccgcagctcctacgtgtacttggagggccgctgcctcaattgcagcagcggctccaagcgaggggtgagtgttgagcggggtgtgggcgggctggggatgggtcccatggccgaggggacggggcctgcaggcagaagtgg

SEQ ID NO: 11004 - DNA, 201 bp, Artificial Sequence
  Synthetic polynucleotide
gctcaatggaaatctgcgtgataaaggtggagatcaaggacctgaacgacaatgcgcccagtttcccggcagcacagatcgagctggagatctcggaggcagccagccctggcacgcgcatcccgctggacagcgcttacgatccagactcaggaagctttggcgtgcagacttacgagctcacgcccaacgagctgttcg

SEQ ID NO: 11005 - DNA, 201 bp, Artificial Sequence
  Synthetic polynucleotide
tccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctcca

SEQ ID NO: 11006 - DNA, 201 bp, Artificial Sequence; identical to SEQ ID NO: 10798
  Synthetic polynucleotide

SEQ ID NO: 11007 - DNA, 201 bp, Artificial Sequence
  Synthetic polynucleotide
gaggcctgtcctgcactgtgtgcatcccctagatttggagatggctatatcgtcacaatgaagatcaaatccccgaaggacgacctgcttcctgacctgaaccctgtggagcagttcttccaggggaacttcccaggcagtgtgcagagggagaggcactacaacatgctccagttccaggtctcctcctcctccctggcg

SEQ ID NO: 11008 - DNA, 201 bp, Artificial Sequence
  Synthetic polynucleotide
tagagtgagaggcgggctgacttctggtcatggccgtggcgcgtgagcccatcttctctttcctcagtgcctttgtggtggagcggcagccctgcatgcccatgcatcctgaccggcccctcgtcatcaagaccggcgtccagttcactactaaagtcaggtaggccatgccacttccatttccagtagagattttactga

SEQ ID NO: 11009 - DNA, 201 bp, Artificial Sequence
  Synthetic polynucleotide
tgtgaactttaaaaaatttcaggcctcccgaggagcccagacagctgcagccacagctccccgtatcaagaaatttgccatctatcgatgggacccagacaaggctggagacaaacctcatatgcagacttatgaagttgaccttaataagtgagtatctctgtgaaagccagctattgaaggagagttcttgatttgatt

SEQ ID NO: 11010 - DNA, 201 bp, Artificial Sequence
  Synthetic polynucleotide
tttaagtgaggatgtgtgaggcatcccacctcctacaccacaccaacagcatgacctctctctctgtttcaggactcatatccaggctcaaatatccagtgtctcaacaaaacaagaatgcaccttccactgcaggcctgggatacggtaactccttatttctctggggtagggtggactggccagttgcaaaaactacct

SEQ ID NO: 11011 - DNA, 203 bp, Artificial Sequence
  Synthetic polynucleotide
cgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgt

SEQ ID NO: 11012 - DNA, 201 bp, Artificial Sequence
  Synthetic polynucleotide
taaattctggattccttttaggccaccaccacctatcatgacagatggtgaagatgcggattacactcattttacaaaccagcagagttccacacggcatttctcaaaatcagagtcctctcataaaggtaagaagagtatgtatggtcaagtttaggatcttctttttttatataagcctcgtgttgtagtggaaaaatc

SEQ ID NO: 11013 - DNA, 201 bp, Artificial Sequence
  Synthetic polynucleotide
gcaggtgagcacctggggtgttgcctgtaccaggtgaaccccccagacctgatgagctgcctgactagccgcaccctcatcacccgcggggagacggtgtccaccccactgagcagggaacaggcactggacgtgcgcgacgccttcgtaaaggtgggctggagggaaggggccgcttgctcgccctaccccttgggaagt

SEQ ID NO: 11014 - DNA, 201 bp, Artificial Sequence; identical to SEQ ID NO: 10927
  Synthetic polynucleotide

SEQ ID NO: 11015 - DNA, 201 bp, Artificial Sequence
  Synthetic polynucleotide
tcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggtt

SEQ ID NO: 11016 - DNA, 201 bp, Artificial Sequence
  Synthetic polynucleotide
ggttggcagtttctgatgtttttcttcatcttggatattgtaggtgccactcccgggagagccaggcagccatggcgggtcaggaggagacgtctcaggatgagacctatgaagtgaagatgaaccatgacacggaggcctgcagtgagcccagcctgctctccacagagatgtgagctctgctgccctctgctgaggctg

SEQ ID NO: 11017 - DNA, 201 bp, Artificial Sequence
  Synthetic polynucleotide
gcgccggacgccacttccggtccccgtggtcacgtgaccgtcacttcacgtgaccgcgcggcggccgctgcggcgcgatggcggcggggctggcgcggctcctgttgctcctcgggctctcggccggcggtgagtggcccggccgtccgcgtccccaggccccgcgcgcgctctgcaccccggcctccccgctcacggtct

SEQ ID NO: 11018 - DNA, 201 bp, Artificial Sequence; identical to SEQ ID NO: 10838
  Synthetic polynucleotide

SEQ ID NO: 11019 - DNA, 201 bp, Artificial Sequence
  Synthetic polynucleotide
ggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgc

SEQ ID NO: 11020 - DNA, 201 bp, Artificial Sequence
  Synthetic polynucleotide
tatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagt

SEQ ID NO: 11021 - DNA, 201 bp, Artificial Sequence
  Synthetic polynucleotide
gcttattgggtaattctttgggattctctattggagtaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtga

SEQ ID NO: 11022 - DNA, 201 bp, Artificial Sequence
  Synthetic polynucleotide
cttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacc

SEQ ID NO: 11023 - DNA, 201 bp, Artificial Sequence
  Synthetic polynucleotide
ggcatttctgccaccctccctctgctttacaatcaggctctcctccttcagatgagatccgcaccctccgagaccagttgcttttactgcacaaccagttactctatgagcgttttaagaggcagcagcatgccctccggaacaggcggctcctccgcaaggtgatcaaagcagcagctctggaggaacataatgctgcca

SEQ ID NO: 11024 - DNA, 201 bp, Artificial Sequence; identical to SEQ ID NO: 10793
  Synthetic polynucleotide

SEQ ID NO: 11025 - DNA, 201 bp, Artificial Sequence
  Synthetic polynucleotide
atggccattttatcctctgactttctgactttggatttgtctctctttccaggtagatgaagagtacaagaatcctcacacagtagaccgagttcctatggggaaggtgcctcatctgtggggccaatccttgtacatcctcagctcgctgttggcagaggtaggggcttagtggcctcacagactggaaaccatgtgatt

SEQ ID NO: 11026 - DNA, 201 bp, Artificial Sequence
  Synthetic polynucleotide
ctgcagcttgtccctggccagggggcacccggcaggcctggtgagggcctccagcccccattgccacccctcactgtctgggtgtgctcactctgccagggcctgcggtccaatgtcctcttgtcttttgatgacacccccgagaaggacagcttcagggcccggagtactagtctcaacgagagacccaagaggtacggc

SEQ ID NO: 11027 - DNA, 201 bp, Artificial Sequence
  Synthetic polynucleotide
gcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataata

SEQ ID NO: 11028 - DNA, 204 bp, Artificial Sequence
  Synthetic polynucleotide
ggcagaggaaggcaggagcagaggctaagccgctcatccccagggcaggtgtagacgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgc

SEQ ID NO: 11029 - DNA, 201 bp, Artificial Sequence
  Synthetic polynucleotide
tgggtgccactggggcgaaggcctggccatctcctgaccctcctctcccacctgcagacgtacaacaccaatgcccaggtccctgacagtgccggcaccgccaccgcctacctgtgtggggtgaaggccaatgagggcaccgtgggggtaagcgcagccactgagcgttcccggtgcaacaccacccaggggaacgaggtc

SEQ ID NO: 11030 - DNA, 201 bp, Artificial Sequence
  Synthetic polynucleotide
cgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggaccc

SEQ ID NO: 11031 - DNA, 201 bp, Artificial Sequence
  Synthetic polynucleotide
aaggggtgtgggccttttgggcagagcaggaagatctgcctatgacttctgcttaccacttcccaggcctcctgtgtcacctggatgacgcctgtgtcagcaacccctgccacgaggatgctatctgtgacacaaatccggtgaacggccgggccatttgcacctgtcctcccggcttcacgggtggggcatgtgaccagg

SEQ ID NO: 11032 - DNA, 201 bp, Artificial Sequence; identical to SEQ ID NO: 11004
  Synthetic polynucleotide

SEQ ID NO: 11033 - DNA, 201 bp, Artificial Sequence
  Synthetic polynucleotide
tgcttcaaagcttctctcgtcagaagcctggggctcactcatcccgtcaagcctacggggcctccctgtacgagcagctggtgtgggaacgtcagttaggacttcccctctacctgtgggctaccaaggccctggaggagctggcctgcaagtgaggaggctgagggcccagggcggggaggcagtgggagtagcacactt

SEQ ID NO: 11034 - DNA, 201 bp, Artificial Sequence
  Synthetic polynucleotide
ccctgcccaggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgcc

SEQ ID NO: 11035 - DNA, 201 bp, Artificial Sequence
  Synthetic polynucleotide
aatgctgaccaaagacctcatgattcccacagttttcaggcaaagggaatatggaaaaagccagaagaaatgcccacagcctgcccaggccacagtccacgtagtcaaatggctctcactggaatctctcctcccttggcacaaagtcctccagaggtccctaaacaacagctcttgagttatgagttaggtcaaggtcat

SEQ ID NO: 11036 - DNA, 212 bp, Artificial Sequence
  Synthetic polynucleotide
agggcctgcaggcacgtggcactcagaagacgtttatttattctttcagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtc

SEQ ID NO: 11037 - DNA, 212 bp, Artificial Sequence
  Synthetic polynucleotide
ctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccc

SEQ ID NO: 11038 - DNA, 201 bp, Artificial Sequence
  Synthetic polynucleotide
gtgacagctttctctgccccctgccaggtgaatgtgatgccctctgccagccgggtgatcctcctggagaacctgacccgcttctggcccatcatccagatccgcataaagcgctgccagcaggtggggccagggatgtggggtgtggccctgggtagggggctctgagccccataaacaggcagatcttaagccagagga

SEQ ID NO: 11039 - DNA, 201 bp, Artificial Sequence
  Synthetic polynucleotide
gcaaaactccatctcaaaaaaaagcgggaggggaaataatttgctgtttcttccttcccttcctcagaatgactgatggatactcaggaagtgacctaacagctttggcaaaagatgcagcactgggtcctatccgaggtaggtatacaagagcttaaaacatttagaactatttattataccaccttagaagtttaagaa

SEQ ID NO: 11040 - DNA, 201 bp, Artificial Sequence
  Synthetic polynucleotide
atctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcaggtatcagatattgggtactcccttccctttgc

SEQ ID NO: 11041 - DNA, 201 bp, Artificial Sequence
  Synthetic polynucleotide
gactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagc

SEQ ID NO: 11042 - DNA, 201 bp, Artificial Sequence
  Synthetic polynucleotide
ccacgcggtgggggaggcggctagcgtggtggacccgggccgcgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggaca

SEQ ID NO: 11043 - DNA, 201 bp, Artificial Sequence
  Synthetic polynucleotide
gatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgc

SEQ ID NO: 11044 - DNA, 201 bp, Artificial Sequence
  Synthetic polynucleotide
ctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacaga

SEQ ID NO: 11045 - DNA, 201 bp, Artificial Sequence
  Synthetic polynucleotide
gtagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaagtaagtagcgttt

SEQ ID NO: 11046 - DNA, 201 bp, Artificial Sequence
  Synthetic polynucleotide
cttctagcagcgaggggagggcagatgtcccaggggctggtcactggagcattcctcccctctgactccccagtacaacgccctgctaagcaacatgagcaggatctactccaccgccaaggtctgcctccccaacaagactgccacctgctggtccctggacccaggtacggcccttgcagctcccctctcggcggtgcc

SEQ ID NO: 11047 - DNA, 201 bp, Artificial Sequence
  Synthetic polynucleotide
aggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcg

SEQ ID NO: 11048 - DNA, 204 bp, Artificial Sequence
  Synthetic polynucleotide
ctcccgaggcggggactccaggggaccgcggccccagcacccaagtgcttcctttgcccccgcctgccctgcagccccaggagccgtacagcttcagcgagccggcccagcaggccatgaggaaggccctcaccctgcgctacgcactcctcccccacctctacacactgttccaccaggcccacgtcgcgggggagaccgtgg

SEQ ID NO: 11049 - DNA, 201 bp, Artificial Sequence; identical to SEQ ID NO: 10789
  Synthetic polynucleotide

SEQ ID NO: 11050 - DNA, 201 bp, Artificial Sequence; identical to SEQ ID NO: 10812
  Synthetic polynucleotide

SEQ ID NO: 11051 - DNA, 201 bp, Artificial Sequence
  Synthetic polynucleotide
cccttgcagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggc

SEQ ID NO: 11052 - DNA, 210 bp, Artificial Sequence
  Synthetic polynucleotide
tgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcagg

SEQ ID NO: 11053 - DNA, 201 bp, Artificial Sequence; identical to SEQ ID NO: 10977
  Synthetic polynucleotide

SEQ ID NO: 11054 - DNA, 201 bp, Artificial Sequence
  Synthetic polynucleotide
cgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccggtaagagcccttccagttatctgcagaatatcccatcccagccctca

SEQ ID NO: 11055 - DNA, 201 bp, Artificial Sequence; identical to SEQ ID NO: 10935
  Synthetic polynucleotide

SEQ ID NO: 11056 - DNA, 201 bp, Artificial Sequence
  Synthetic polynucleotide
cagccgccgcccacccgacgccaggcctcgctccccgcctggcctgtccgcttcagtgttccatccgcgtctgtctccccgcaggccccggacggtgacggtgaaggtggaactgagctgcgcacccggggatctcgatgccgtcctcatcctgcagggtcccccctacgtgtcctggctcatcgacgccaaccacaacat

SEQ ID NO: 11057 - DNA, 201 bp, Artificial Sequence
  Synthetic polynucleotide
ttcttttagaaaaacaatgtggtgagtgtcaacaaggagcctgttgccgagcctgacatcatggccacaaatggcgtggtccatgtcatcaccaatgttctgcagcctccaggtaagtgtcgcatccccactgactctgcagccagtccttttcttcatgtggcagttggtggagagaagaaaaactgttctaaacaatga

SEQ ID NO: 11058 - DNA, 201 bp, Artificial Sequence
  Synthetic polynucleotide
ttttggcccgcttctctctctctctgtctctcggctacagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcc

SEQ ID NO: 11059 - DNA, 201 bp, Artificial Sequence; identical to SEQ ID NO: 10924
  Synthetic polynucleotide

SEQ ID NO: 11060 - DNA, 201 bp, Artificial Sequence
  Synthetic polynucleotide
agatggctttcctgctgcagcaaccagtgctaacttatgtttggcaactggtgtacggggcggtgtggactggatgagaaagttggccttccgctacagacgggtaaaagagatctacaacacctacaaaaataatgttggaggcaagtgattaccaccagtacctcagcaagttaagacagtccagatacaattccaaaa

SEQ ID NO: 11061 - DNA, 201 bp, Artificial Sequence
  Synthetic polynucleotide
aaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttga

SEQ ID NO: 11062 - DNA, 213 bp, Artificial Sequence; identical to SEQ ID NO: 10916
  Synthetic polynucleotide

SEQ ID NO: 11063 - DNA, 201 bp, Artificial Sequence
  Synthetic polynucleotide
ttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaa

SEQ ID NO: 11064 - DNA, 201 bp, Artificial Sequence; identical to SEQ ID NO: 10876
  Synthetic polynucleotide

SEQ ID NO: 11065 - DNA, 201 bp, Artificial Sequence
  Synthetic polynucleotide
agtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctg

SEQ ID NO: 11066 - DNA, 201 bp, Artificial Sequence
  Synthetic polynucleotide
aaaacgcggatgattctaaaacaggatttaggagaccaatgtttatttttcttttagctttgattgctaacccaaggaggaagctggtttgggccataagtgtcaccatgataggtgtcgttctctttgattttgctgccgacttcattgatgggcccatcaaagcctacttatttgatgtctgctcccatcaggacaagg

SEQ ID NO: 11067 - DNA, 201 bp, Artificial Sequence
  Synthetic polynucleotide
ccctttccccatgttaaagcacagaggaccctctttcattacctcccccttccacaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtca

SEQ ID NO: 11068 - DNA, 201 bp, Artificial Sequence
  Synthetic polynucleotide
cagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttag

SEQ ID NO: 11069 - DNA, 201 bp, Artificial Sequence
  Synthetic polynucleotide
cattacttccagctgctttttgaagtgtccaccaaaatgaacgactttttcctttcttcacgcagatttcctcctagagtgccaaaatcttttccattcaacacctcagtcgtgtacaaaaagactctgtttgtagaattcacggatcaccttttcaacatcgctaagccaaggccaccctggatgggtaatgaaaacaat

SEQ ID NO: 11070 - DNA, 201 bp, Artificial Sequence
  Synthetic polynucleotide
tgttttcaggccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtca

SEQ ID NO: 11071 - DNA, 203 bp, Artificial Sequence
  Synthetic polynucleotide
tcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacag

SEQ ID NO: 11072 - DNA, 201 bp, Artificial Sequence
  Synthetic polynucleotide
atgggccagaacggcaacctctactttgccaatgtgctcacctccgacaaccactcagactacatctgccacgcccacttcccaggcaccaggaccatcattcagaaggaacccattgacctccgggtcaaggccagtgagtctcagaggctctgcactctctccctgactcctttcaccctcaggcatggcccttcccac

SEQ ID NO: 11073 - DNA, 205 bp, Artificial Sequence
  Synthetic polynucleotide
aggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaag

SEQ ID NO: 11074 - DNA, 201 bp, Artificial Sequence
  Synthetic polynucleotide
caatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagat

SEQ ID NO: 11075 - DNA, 206 bp, Artificial Sequence
  Synthetic polynucleotide
cccgggtgcaccttcatcaacaagcccacgcggcctggctgtgagatgtgctgccgggcgcgccccgaggcctaccaggtccccgcctcataccagcccgacgaggaggagcgagcgcgcctggcgggcgaggaggaggcgctgcgtcagtaccagcaggtgggcgggaaagtccctggacagacacctgcagaccgcacggggga

SEQ ID NO: 11076 - DNA, 201 bp, Artificial Sequence
  Synthetic polynucleotide
aggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggct

SEQ ID NO: 11077 - DNA, 207 bp, Artificial Sequence
  Synthetic polynucleotide
gactgcaacaccaacagtactctctagttcccactcacatagggggaagcccagcattttctaccagcagggcttgccagacagtcatctaactgaagaggctttgaaagtttcagctgctcctggactagctgaccagacaactggcatgtcaactctaacctctacttcctactcacatagagagaagcctggtactttttacca

SEQ ID NO: 11078 - DNA, 201 bp, Artificial Sequence
  Synthetic polynucleotide
ggtgcctgccaggggggaggctcctaaggcccaccccggtgttttccccgccagctgccttctgccagagcctgggcgccgccgcccccgaggtccgctgctgtgtggatgccgtgaacttcgtggccgagagcacgagagatcaggaggccaccggcgaggtgggacaggagccagaggcgggtggagcgaggcagaggc

SEQ ID NO: 11079 - DNA, 204 bp, Artificial Sequence
  Synthetic polynucleotide
gaagactcctgtacgagaagcagcagggccgggggcatcgtgaatcaggctccgggatgtgtgtgggatagagagttgggaagtgctctggacgtagtcgccatggaggtaactggaatgatacgcgccgtggtggtcttggtgctgatggtagtctcggtgccggtgggtctggtggtagtggtgctgtgtgtggtggggatg

SEQ ID NO: 11080 - DNA, 201 bp, Artificial Sequence
  Synthetic polynucleotide
aacgaggtgtggacatggccaggcttggtcccgagtggagccaacccatgaagaggctgacacttggcaacaccacctcctccgtgatcctcaccaactacatggacgtgagtgcttggctcagcccctcgctccctccctgtctcctttccctcatggacctagggctttctttgctgcaagactcaccctttccaagct

SEQ ID NO: 11081 - DNA, 201 bp, Artificial Sequence
  Synthetic polynucleotide
gtacctgggaaaattatgcttactaatgtggttttaatttcatcatgtttcatataggattcacctttatttgatcttattaaacaatcaaaggaccgagaaggaccaactgatcaccttgaatctgcttgtcctcttaatcttcctctccagaataatcacactgcagcagatatgtaagcaaaatatatgttatgttga

SEQ ID NO: 11082 - DNA, 201 bp, Artificial Sequence
  Synthetic polynucleotide
tccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgat

SEQ ID NO: 11083 - DNA, 201 bp, Artificial Sequence; identical to SEQ ID NO: 10850
  Synthetic polynucleotide

SEQ ID NO: 11084 - DNA, 214 bp, Artificial Sequence; identical to SEQ ID NO: 10715
  Synthetic polynucleotide

SEQ ID NO: 11085 - DNA, 201 bp, Artificial Sequence
  Synthetic polynucleotide
caaggccaaccgcgagaagatgacccagatcatgtttgagaccttcaacgtgcccgccatgtacgtggccatccaggccgtgctgtccctctacgcctccggcaggaccaccggtgagtgcccgctgcccccagtcccctctcccgcccccgcccccgcccccgcccccgccgctagcgctgagagcctagcctcggcctc

SEQ ID NO: 11086 - DNA, 201 bp, Artificial Sequence
  Synthetic polynucleotide
cctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccgga

SEQ ID NO: 11087 - DNA, 206 bp, Artificial Sequence
  Synthetic polynucleotide
ttacgtgttccaaggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatg

SEQ ID NO: 11088 - DNA, 201 bp, Artificial Sequence; identical to SEQ ID NO: 11034
  Synthetic polynucleotide

SEQ ID NO: 11089 - DNA, 201 bp, Artificial Sequence
  Synthetic polynucleotide
aagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggc

SEQ ID NO: 11090 - DNA, 201 bp, Artificial Sequence
  Synthetic polynucleotide
ctttgagtttcacctggtgggacctcttgtccttcaggtcctggctgctgtctacaaggccctgaatgaccatcatgtttacctggagggcaccctgctaaagcccaacatggtgactgctggacatgcctgcaccaagaagtatactccagaacaagtagctatggccaccgtaacagctctccaccgtactgttcctgc

SEQ ID NO: 11091 - DNA, 201 bp, Artificial Sequence
  Synthetic polynucleotide
gcagtggaaactgcttcctgggaatactgatgatgtgccttcccttggactgtgctgcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacata

SEQ ID NO: 11092 - DNA, 203 bp, Artificial Sequence
  Synthetic polynucleotide
tgcacacacacacacgctttttacctgagtggttaaaatgtcactctgagaggatagccctgagcagtcttcagagacgcttgtttcactctcacacccagatgctgcttcaccttaaataacaaaaacagaggttcagatgtaaaagcagactataaacgctgcaacttgctgtgtctttttcttctcattggcaggactgg

SEQ ID NO: 11093 - DNA, 201 bp, Artificial Sequence
  Synthetic polynucleotide
acgtaccatctttcccccaggtggtcaagtaccccctgcacgccatcatggagatcaaggagtacctgattgacatggcctccagggcaggcatgcactggctgtccaccatcatccccacgcaccacatcaacgcgctcatcttcttcttcatcgtcagcaacctcaccatcgacttcttcgccttcttcatcccgctgg

SEQ ID NO: 11094 - DNA, 201 bp, Artificial Sequence
  Synthetic polynucleotide
ctggcatcgctcctcagtatacctcctgtcactgtcccttcaggactggagccgggcctcgtctttcttggcttcctcctggtggttgggatggggctggctggggccttcctggcccattatgtgaggtgagtagtggaatgaggtaagtaggaagtgagcttgtgccagaaatggaagtctgcagcaaaaacagcaggc

SEQ ID NO: 11095 - DNA, 201 bp, Artificial Sequence
  Synthetic polynucleotide
cacgccatcggaggagccaggcgggccccagatgctgacctcccaggctccgtgtgtagatggcttcgaggagccaggagcacggcagcgggccctcagcgcagtcagcgtcctcaccagcgcactggaaggtcagcaaccccaggtcatttaagcaccccccacttccgctgcaggtaccctcatctttatcccagcctg

SEQ ID NO: 11096 - DNA, 201 bp, Artificial Sequence
  Synthetic polynucleotide
actgacaagtccccttgtttgtgcccgcagaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaagaagggaacccccaaatttaatta

SEQ ID NO: 11097 - DNA, 201 bp, Artificial Sequence
  Synthetic polynucleotide
tggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactgg

SEQ ID NO: 11098 - DNA, 201 bp, Artificial Sequence
  Synthetic polynucleotide
aggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgtt

SEQ ID NO: 11099 - DNA, 201 bp, Artificial Sequence
  Synthetic polynucleotide
ggaggtgggtacggcccagtgggggggagagggacacgccctgggctctgcccagggtgcagccggactgactgagcccctgtgccgcccccagttccgccacaaagtccgctttgaagggatggagccgctgccctctcgctcctccaggggctccaaggtatccccggatgtgcccccacccagcgctggctccgatgc

SEQ ID NO: 11100 - DNA, 201 bp, Artificial Sequence
  Synthetic polynucleotide
cgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcc

SEQ ID NO: 11101 - DNA, 212 bp, Artificial Sequence
  Synthetic polynucleotide
acgagcagtcgtccatggggtctgagccgttgctgctacgagtccgcggggtgtagaagtcggggctcccggtgtcgttttccgagcccaggagcttgccctgggactccaggctggagctccggtgcctaaagtgcagtgcgaggctgtgcagtcgggtggggctgatgtccaccgacctgccgggagacgacccgggttggtctgggggt

SEQ ID NO: 11102 - DNA, 201 bp, Artificial Sequence; identical to SEQ ID NO: 10714
  Synthetic polynucleotide

SEQ ID NO: 11103 - DNA, 201 bp, Artificial Sequence
  Synthetic polynucleotide
attttggttccagaccaacatgatcccgggctcccccggcagtacggagttagagggtggcttcagtcggcaacgcaagcgcaagttgtccttccgcaggcgcacggacaagggtgaggcgggggaggggaggaagggggagggcggggacaaggtgaggctgggagctggaaggcggggtgggccgtgtctgctttaccc

SEQ ID NO: 11104 - DNA, 210 bp, Artificial Sequence
  Synthetic polynucleotide
caggacctggaccagactccagggcgtgcccccccaccccacctgcactccctcacctgttgagctggcgctggagggcatccagcctgctctccacgtcgccccggggccgccgacccgggctggagagggggatgttgaggaggctgggggtgggggcggggcatcgagggagctcctggtactggcggccccgactgtccccccaga

SEQ ID NO: 11105 - DNA, 201 bp, Artificial Sequence; identical to SEQ ID NO: 11095
  Synthetic polynucleotide

SEQ ID NO: 11106 - DNA, 201 bp, Artificial Sequence
  Synthetic polynucleotide
cacgaccacgtgcctctcctctcccgcaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcacccagcagcgagtcgctggccctggacgaagt

SEQ ID NO: 11107 - DNA, 207 bp, Artificial Sequence
  Synthetic polynucleotide
cgactcggaacggcttccgcggccggggcagcgagggccgggggcggcgggcgggatgagtgcggtgtgcggtggagcggcgcggatgctgcggacgccgggacgccacggctacgccgccgagttctccccgtacctgccgggccgcctggcctgcgccaccgcgcagcactacggcatcgcgggtgaggcggcgccgcgcagctg

SEQ ID NO: 11108 - DNA, 203 bp, Artificial Sequence
  Synthetic polynucleotide
ctgcccctccctgcccagcccctctcacctttgggacttggggcactttctcccagctcagcggctggggccggggcttctccaggggctccagtggcctcagcaggggcaggggcaggggccagcatgggctctgccttctctggaggggatcagatgggagtcgtggtgcagccactaaccagagacccctccaccctctc

SEQ ID NO: 11109 - DNA, 201 bp, Artificial Sequence
  Synthetic polynucleotide
actgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgt

SEQ ID NO: 11110 - DNA, 207 bp, Artificial Sequence
  Synthetic polynucleotide
tgcaactgtttcttcaggcacagacagcacacattgtcctggaagatggaactaagatgaaaggttactcctttggccatccatcctctgttgctggtgaagtggtttttaatactggcctgggagggtgagtaatgcttttccaaggctttatttttcctctagtagagaaataactggaagatctcactcatggtggtaagttga

SEQ ID NO: 11111 - DNA, 201 bp, Artificial Sequence
  Synthetic polynucleotide
tgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctg

SEQ ID NO: 11112 - DNA, 201 bp, Artificial Sequence
  Synthetic polynucleotide
caccccttcgcgcagcgcacgctcaccgcgcgcttccaggtcaacaacacccgcccgccgcacgtgcagctgttgcgcaagccggtgctcacggccatggggctgctggcgctgctgggtgagccggggccgctggggtgggccggccagggccctccaggctggggagcggctcctgcgaaggccccgctgcggggagcg

SEQ ID NO: 11113 - DNA, 201 bp, Artificial Sequence
  Synthetic polynucleotide
acgtgtggtacccctgtctgctcaccatatgcttttgttttaggttctcccatggcgccagccagtgtgggcaattgcagtgtgggcaactgcagcccggaggcagtgtggcccaaaactgaacccctggagatggaagtaccccaggcacctatacagcccttctatagctctccagaactgtggatcagctctctccca

SEQ ID NO: 11114 - DNA, 201 bp, Artificial Sequence
  Synthetic polynucleotide
ggacactgctggctccacacaggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggtgccgcggcccgtgccccatgccacccgcccgc

SEQ ID NO: 11115 - DNA, 201 bp, Artificial Sequence; identical to SEQ ID NO: 11099
  Synthetic polynucleotide

SEQ ID NO: 11116 - DNA, 201 bp, Artificial Sequence; identical to SEQ ID NO: 11100
  Synthetic polynucleotide

SEQ ID NO: 11117 - DNA, 201 bp, Artificial Sequence
  Synthetic polynucleotide
atttcacacgatcctttgatagtggcagtgtccgcctgcagatctcaaccccagacatcaaggataacatcgttgctcagctgaagcagctgtaccgcatccttcaaacccaggagagctggcagcccatgcagcccacccccagcatgcaactgccccctgccctgcctccccagtaattgtgaatgccatcttcttcct

SEQ ID NO: 11118 - DNA, 201 bp, Artificial Sequence
  Synthetic polynucleotide
aacgtgtgctacgatcactacttccccatctcccacatccggctatgggccctgcagctgatcttcgtgtccacgccagcgctcctagtggccatgcacgtggcctaccggagacatgagaagaagaggaagttcatcaagggggagataaagagtgaatttaaggacatcgaggagatcaaaacccagaaggtccgcatc

SEQ ID NO: 11119 - DNA, 201 bp, Artificial Sequence; identical to SEQ ID NO: 10951
  Synthetic polynucleotide

SEQ ID NO: 11120 - DNA, 201 bp, Artificial Sequence
  Synthetic polynucleotide
gagtagagtgtgggttggggggtcccaagggagggtgtgctgagctgcccccaccctgcccccaggtgctgaagggcttccctgagtgcctgcaggctgacatctgcctgcacctgaaccgctcactgctgcagcactgcaaacccttccgaggggccaccaagggctgccttcgggccctggccatgaagttcaagacca

SEQ ID NO: 11121 - DNA, 201 bp, Artificial Sequence
  Synthetic polynucleotide
taacatttataatctgattctttttcttttgggctactcagttatgctaattaagttcctttatctgcagatatgaaaatgagcagccatttcgaaaggcggcagaagaggaaattaactctctgtataaagtcattgatgaggctaatttgactaaaatggacctggagagtcaaatagaaagtctgaaagaagaacttg

SEQ ID NO: 11122 - DNA, 213 bp, Artificial Sequence
  Synthetic polynucleotide
atagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttg

SEQ ID NO: 11123 - DNA, 201 bp, Artificial Sequence
  Synthetic polynucleotide
tctctccctgttcccctgcagaaggccgggagtgtgtcaactgtggggccacagccacccctctctggcggcgggacggcaccggccactacctgtgcaatgcctgtggcctctaccacaagatgaatgggcagaaccgaccactcatcaagcccaagcgaagactggtaggagcgggcacaggtggctgggagggggctg

SEQ ID NO: 11124 - DNA, 201 bp, Artificial Sequence
  Synthetic polynucleotide
tgttctcggcctgcagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgggtgccgcccgcccctcggccacttgccttgg

SEQ ID NO: 11125 - DNA, 201 bp, Artificial Sequence; identical to SEQ ID NO: 10718
  Synthetic polynucleotide

SEQ ID NO: 11126 - DNA, 208 bp, Artificial Sequence
  Synthetic polynucleotide
gctggctctgcaccgcatcaggactgtgctcatgttccgggacagcaggcagtccagcaatgaggtcaaggtcatccagcaggacaacagatggctgcatccacactgcctctgagaaagccacctctagggttttttgtatgttttcaagcctttttccttaatacagaagatatgaaatggtttcagtatcatttcagtgctggga

SEQ ID NO: 11127 - DNA, 201 bp, Artificial Sequence
  Synthetic polynucleotide
actctggaatgttctggaaatttctggaatcttctggtatagctgatgatctcgttcctgccctgactccgcttcttctgccccaggagtgaactggtgtgagaggaccaccctgagcaatggcggctgccagtatctgtgcctccctgccccgcagatcaacccccactcgcccaagtttacctgcgcctgcccggacgg

SEQ ID NO: 11128 - DNA, 210 bp, Artificial Sequence; identical to SEQ ID NO: 11104
  Synthetic polynucleotide

SEQ ID NO: 11129 - DNA, 201 bp, Artificial Sequence
  Synthetic polynucleotide
cactgttacctaatttttaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggaga

SEQ ID NO: 11130 - DNA, 201 bp, Artificial Sequence
  Synthetic polynucleotide
aatgtggttttaatttcatcatgtttcatataggattcacctttatttgatcttattaaacaatcaaaggaccgagaaggaccaactgatcaccttgaatctgcttgtcctcttaatcttcctctccagaataatcacactgcagcagatatgtaagcaaaatatatgttatgttgaccattcaaactgcaaatagatttt

SEQ ID NO: 11131 - DNA, 201 bp, Artificial Sequence
  Synthetic polynucleotide
cgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctgg

SEQ ID NO: 11132 - DNA, 206 bp, Artificial Sequence
  Synthetic polynucleotide
tgagcaagccgctggctctgcaccgcatcaggactgtgctcatgttccgggacagcaggcagtccagcaatgaggtcaaggtcatccagcaggacaacagatggctgcatccacactgcctctgagaaagccacctctagggttttttgtatgttttcaagcctttttccttaatacagaagatatgaaatggtttcagtatcatt

SEQ ID NO: 11133 - DNA, 201 bp, Artificial Sequence
  Synthetic polynucleotide
gaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggctt

SEQ ID NO: 11134 - DNA, 201 bp, Artificial Sequence
  Synthetic polynucleotide
ggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatt

SEQ ID NO: 11135 - DNA, 201 bp, Artificial Sequence
  Synthetic polynucleotide
cccaggccaggaggcccctggggggccagagatgggtaaggggaggtactggcctcaggccaaaggtgctgccgcctccgcagggaacaccagctggctgatgagcctggagaacccgctcagccctttctcctcggacatcaacaacatgcccctgcaggagctgtctaacgccctcatggcggctgagcgcttcaagga

SEQ ID NO: 11136 - DNA, 201 bp, Artificial Sequence
  Synthetic polynucleotide
tgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagc

SEQ ID NO: 11137 - DNA, 201 bp, Artificial Sequence
  Synthetic polynucleotide
ttaaacaatcttttaaaatgtcattttagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaaggtatggtatggc

SEQ ID NO: 11138 - DNA, 201 bp, Artificial Sequence
  Synthetic polynucleotide
gctcatctgtttattttctgtccactacagaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaa

SEQ ID NO: 11139 - DNA, 201 bp, Artificial Sequence; identical to SEQ ID NO: 11013
  Synthetic polynucleotide

SEQ ID NO: 11140 - DNA, 201 bp, Artificial Sequence
  Synthetic polynucleotide
ccttctctgcctcctccagctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtg

SEQ ID NO: 11141 - DNA, 201 bp, Artificial Sequence
  Synthetic polynucleotide
gagtcacccaacctttctgcacacaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtgga

SEQ ID NO: 11142 - DNA, 201 bp, Artificial Sequence
  Synthetic polynucleotide
gaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattc

SEQ ID NO: 11143 - DNA, 201 bp, Artificial Sequence
  Synthetic polynucleotide
tcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtccaggtcctggcgg

SEQ ID NO: 11144 - DNA, 201 bp, Artificial Sequence
  Synthetic polynucleotide
caagagcaagttcggcagcggctactccctgcgggccaaggtgcagagtgaagggcaacaggaggcgctggaggagttcaaggccttcgtggacctgacctttccaggtgtgtgccggccccggcagcccccactgggtgggccctgggcccctacctaggcctctcccatctgctgtgcggagcgtctgtgcctcgcccc

SEQ ID NO: 11145 - DNA, 201 bp, Artificial Sequence
  Synthetic polynucleotide
aggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgac

SEQ ID NO: 11146 - DNA, 201 bp, Artificial Sequence
  Synthetic polynucleotide
atccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcc

SEQ ID NO: 11147 - DNA, 201 bp, Artificial Sequence
  Synthetic polynucleotide
ctcttcccgattgcagatgtggatccagctgttgtacagtgcctgcttctggtggctgttttgctatgcagtggatgcttatctggtgatccggagatcggcaggactgaggtattcaccgaggaaatgggatttctgccctagttctattttagagggaagataagagatggcactgagcgtttaaaagtattttgcagt

SEQ ID NO: 11148 - DNA, 201 bp, Artificial Sequence
  Synthetic polynucleotide
gtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgccc

SEQ ID NO: 11149 - DNA, 201 bp, Artificial Sequence
  Synthetic polynucleotide
cctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttcca

SEQ ID NO: 11150 - DNA, 201 bp, Artificial Sequence
  Synthetic polynucleotide
ggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgct

SEQ ID NO: 11151 - DNA, 201 bp, Artificial Sequence
  Synthetic polynucleotide
tagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggctttt

SEQ ID NO: 11152 - DNA, 201 bp, Artificial Sequence; identical to SEQ ID NO: 10990
  Synthetic polynucleotide

SEQ ID NO: 11153 - DNA, 201 bp, Artificial Sequence
  Synthetic polynucleotide
agttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaataggtacaacggcgggc

SEQ ID NO: 11154 - DNA, 201 bp, Artificial Sequence
  Synthetic polynucleotide
gcacagcctcaaccccgacgcctcgggctccagctgcagcctggcccggacgcgctcccgagaaagctgcgccagcgtgcgccgcgcctcgtcggccgacgacatcgaggccatgcgcgccggggtgctgcccccgccaccgcgccacgccagcaccggtgagggcgccgcgggacccgttccgccccagcccacgcttct

SEQ ID NO: 11155 - DNA, 201 bp, Artificial Sequence
  Synthetic polynucleotide
ccctgtggctgtcaggcctgagggtcgggtggggcgtggggaaagtccctgactcggctggatctccctgtggcagggttgcttcacccacaccgtcatgtactacggccactacagtaacgccacgctgaaccagccgtgtggcagccccctggatggcagccagtgcacacccagggtgggtggcctgccctacaacat

SEQ ID NO: 11156 - DNA, 201 bp, Artificial Sequence; identical to SEQ ID NO: 11026
  Synthetic polynucleotide

SEQ ID NO: 11157 - DNA, 209 bp, Artificial Sequence
  Synthetic polynucleotide
tctccttcacttactgctgtggactctccttaggggaatgtcgggtgcttcttcctcaagcagctcagcactttgtaggagagcatggatctctgggtgcagatcctccatactagcttcccctgaggccagtgctctgcagtgcaataccaaggcgacatctggattataaaaatgaaaataccggcatactctacttgcttcatgca

SEQ ID NO: 11158 - DNA, 201 bp, Artificial Sequence
  Synthetic polynucleotide
tgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtcc

SEQ ID NO: 11159 - DNA, 201 bp, Artificial Sequence
  Synthetic polynucleotide
gcctcttgactcctactgtcctccctcctcccacaggatgtcctctagggttttatggaaaagattgtgcactgatatgccaatgtcaaaacggagctgactgcgaccacatttctgggcagtgtacttgccgcactggattcatgggacggcactgtgagcagagtaagtatgagagtgtggcatcactgggtggtattt

SEQ ID NO: 11160 - DNA, 201 bp, Artificial Sequence
  Synthetic polynucleotide
ccaccattcagggagcctgggaggtgcctttcgcacccagacccccgtgggctctctcctgatggctcctgcccttttcccttccctcctcagcccccagtgcctggtgctcacggggccccccaacttccgcccggccctggtggactttgtgggcaccttcacccggaacctcagcctgatgatctgtggccacgtgct

SEQ ID NO: 11161 - DNA, 201 bp, Artificial Sequence
  Synthetic polynucleotide
ccaccacggcatccggccctgcgtcatctcgcgccagctgcgcgtgtcccacggctgcgtctccaagatcctgtgcaggtaccaggagactggctccatacgtcctggtgccatcggcggcagcaagcccaaggtgagcgggcgggccttgccctcctggctcccagactgtggtcccctgtgttggggaagaccgggcgg

SEQ ID NO: 11162 - DNA, 201 bp, Artificial Sequence
  Synthetic polynucleotide
ttctccctccccacccttggtgcagaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgcccc

SEQ ID NO: 11163 - DNA, 201 bp, Artificial Sequence
  Synthetic polynucleotide
agctaagagggaagcctggctgcagttgagggccgaaattgaagccctgaccgactcctggttgacactggccctgaaagcactctcgctcattcactcccggtgaggctctctgcggggtctttgccaggaaatgggcaatgctcgtgcttgttcattttggagatttatttttcaacagtctttgttttctttttgttc

SEQ ID NO: 11164 - DNA, 201 bp, Artificial Sequence
  Synthetic polynucleotide
gtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggct

SEQ ID NO: 11165 - DNA, 201 bp, Artificial Sequence
  Synthetic polynucleotide
ggcccctgctggctcgtggcgcggggcggctgcggagggccccgcgcctggtcccagtgcggcggcggagggctccgagcctggtcccagcgcagcgcagccggacgcgtctgccggccccctggcccggctggcacggagcagagccgcgggctggggcacggctcgacgtcgagaggcggcccctgggtggggacaggg

SEQ ID NO: 11166 - DNA, 203 bp, Artificial Sequence
  Synthetic polynucleotide
cggaaaaatctattatagccccagcattctccaacttcaaagtcagatgcaaattctcgaatgatattttttgtaggatcattacaggactggtgaaccatctctacacgatattcatatctaaaattgaaaaacagaccattactatacagttagtaaagtaagaataaaaaacaaactcatctaaacattaaggtcactaa

SEQ ID NO: 11167 - DNA, 212 bp, Artificial Sequence; identical to SEQ ID NO: 11037
  Synthetic polynucleotide

SEQ ID NO: 11168 - DNA, 201 bp, Artificial Sequence
  Synthetic polynucleotide
ctgggaagatgagatgaggatcccatgccctaatcgccaattctgacccattcctcgatgtctatagacctgatcgtgggagcttacggggccaaccaggtggctgtgtacaggtgagcactggctccaggggcgggatggggaaggtcctgtgccatcaagaggaggccaggccaggaggagccacaatggcaagcctac

SEQ ID NO: 11169 - DNA, 201 bp, Artificial Sequence
  Synthetic polynucleotide
acttggggatggtggaggagtggggaggggtatcttgggcctagctaagttgtgtttttctttttcatttcacagggtccttctggtcctgttggtcctgctggtgctgttggcccaagaggtcctagtgtatgtacatgctgaagatttctttgcaacactaacatttagagagaatcagtccaaaacatctgttaagaa

SEQ ID NO: 11170 - DNA, 201 bp, Artificial Sequence
  Synthetic polynucleotide
gcaagagctccctgttccggatcctgggtgggctctggcccacgtacggtggtgtgctctacaagcccccaccccagcgcatgttctacatcccgcagaggtaaggaagcccgtgcgcctctcctccacctcttcctgcctgtgcgctcacacatggcttcctgcagaggcccaggaagtggtgaagagtcagcacctcag

SEQ ID NO: 11171 - DNA, 201 bp, Artificial Sequence
  Synthetic polynucleotide
gcgcagcggccgctgccgccgccgccgccgccgccgccgccgctgggggcctggcgctggggctgcaccctgggggcgcgcagggcggcgcgggcctcccggcgcaggcggcgctctacggccacccggtctacggctactccgcggcggcggcggcggctgcgctggcgggccagcacccggcgctctcctactcgtacc

SEQ ID NO: 11172 - DNA, 201 bp, Artificial Sequence
  Synthetic polynucleotide
cagggctgctgagggaagggactgaggtgcgcgtgtctctgcagcccaggggtcactgtccttctgcatgctggaagccagccaggacatgggccgcacgctcgagtggcggccgcgtactccagccttggtccggggctgccacttggaaggcgtggccggccacaaggaggcgcacatcctgagggtcctgccgggcca

SEQ ID NO: 11173 - DNA, 201 bp, Artificial Sequence
  Synthetic polynucleotide
cggagaccgacgaggacgagggcgcgggcgcggcggaggcgggcgcggaaggcgcggaggagggcgcggcggggctcgagggcacggcggccacggcggcggcgggggcgacggcgcgggttgtggcggccgcaggccgggccctgcgaggcctcagctaccgcagcctgcggcggcgcgtgcggcggctgcggcggctta

SEQ ID NO: 11174 - DNA, 201 bp, Artificial Sequence
  Synthetic polynucleotide
agccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactact

SEQ ID NO: 11175 - DNA, 201 bp, Artificial Sequence
  Synthetic polynucleotide
cgagcccttggggcgcactcgctcagctgtcttcggttctctctgcaggtgagcagcagtactcggtgccgcccccggtctatggctgccacacccccaccgacagctgcaccggcagccaggctttgctgctgaggacgccctacagcaggtaggaaggcgctgggctctgcgtctgggtccttgggaccccggagggga

SEQ ID NO: 11176 - DNA, 201 bp, Artificial Sequence
  Synthetic polynucleotide
gccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccag

SEQ ID NO: 11177 - DNA, 201 bp, Artificial Sequence
  Synthetic polynucleotide
aggcggaggccccctcttccccaggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtc

SEQ ID NO: 11178 - DNA, 201 bp, Artificial Sequence
  Synthetic polynucleotide
tacagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagcca

SEQ ID NO: 11179 - DNA, 201 bp, Artificial Sequence; identical to SEQ ID NO: 11143
  Synthetic polynucleotide

SEQ ID NO: 11180 - DNA, 203 bp, Artificial Sequence
  Synthetic polynucleotide
ctggagccaccaccagagcttctggcactggaaatggagctgccagaactgctggagccactgtagctactgaaaccgctggagtcacccttcccagtgaggcaggggtcgttaggggaggtgatacgcgtggggtccttacaagggtctgagaaggtgccaatgctcttagccaaggtccctgtggaggaaagcagtggtta

SEQ ID NO: 11181 - DNA, 201 bp, Artificial Sequence
  Synthetic polynucleotide
cactggggagaggctccccgcagcccactctgactgtgccctctgccctgcaggagagtatgacctgcggcgctgggagaagtgggagctggacctggacatcaaggaggtcttcgtccaccccaactacagcaagagcaccaccgacaatgacatcgcactgctgcacctggcccagcccgccaccctctcgcagaccat

SEQ ID NO: 11182 - DNA, 201 bp, Artificial Sequence
  Synthetic polynucleotide
atctgcttatgaccaggagccactcaagcagcactctcccttcacaggtggtattccaaacacatgactcggagtcaggctgagcaactgctaaagcaagaggtaagtgtggaaccactagcacacagcattctccttgcataagtgaggatcttgaactgagggcctgttctgccccctacctttgggcaaggcagtgtc

SEQ ID NO: 11183 - DNA, 201 bp, Artificial Sequence
  Synthetic polynucleotide
gccggacaggcagccccggtgagggagcccacgtgtcagcagctgtggccaagactgtgaggatgacgctagtgattgtggtcgtctatgtgctgtgctgggcacccttcttcctggtgcagctgtgggccgcgtgggacccggaggcacctctggaaggtgggtgtagccgtggctagggctgacggggccacttgggct

SEQ ID NO: 11184 - DNA, 201 bp, Artificial Sequence; identical to SEQ ID NO: 10743
  Synthetic polynucleotide

SEQ ID NO: 11185 - DNA, 201 bp, Artificial Sequence
  Synthetic polynucleotide
ggagctgggaccacagtggctgagcttccggtgtgtcttccaggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcac

SEQ ID NO: 11186 - DNA, 201 bp, Artificial Sequence; identical to SEQ ID NO: 10816
  Synthetic polynucleotide

SEQ ID NO: 11187 - DNA, 201 bp, Artificial Sequence
  Synthetic polynucleotide
attcttacggcctgatgttcgacctgcctctccccagagtcctgcctctgccccctggagatgaatgtggcccaggaattccagctccgacgacggcagctggggagccaaggaagttcctggagcaagtggagcagccccgtgtgcgttccccctggtaagatcactctgagtacaggaacaggggcaagcattagaaat

SEQ ID NO: 11188 - DNA, 203 bp, Artificial Sequence
  Synthetic polynucleotide
agaggctctgagaagaagaccagcggccccctttctcctcccacagggcctcctggcccggcgcctgcaggccccgccgtgcggctggggtccgtgccctactccctgctcttccgcgtcctgctgcagtgcttgaagcaggtgagtggggccgggcagggaccatccgtcccacgttgggccaggaggacagggagctgcca

SEQ ID NO: 11189 - DNA, 201 bp, Artificial Sequence
  Synthetic polynucleotide
tgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcag

SEQ ID NO: 11190 - DNA, 201 bp, Artificial Sequence
  Synthetic polynucleotide
gctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttga

SEQ ID NO: 11191 - DNA, 201 bp, Artificial Sequence
  Synthetic polynucleotide
ggtaagcagtggccccgaacctacccccaaacccgggctcgctcccgggaggcggggcccgctctcactggctctccctccagccggcggccagaaatgcacggtctccatcaacgtcctgctcgcccagaccgtcttcttgttcctcattgcccagaaaatcccagagacttctctgagcgtgccgctcctgggcaggtg

SEQ ID NO: 11192 - DNA, 201 bp, Artificial Sequence
  Synthetic polynucleotide
ggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggc

SEQ ID NO: 11193 - DNA, 207 bp, Artificial Sequence; identical to SEQ ID NO: 10878
  Synthetic polynucleotide

SEQ ID NO: 11194 - DNA, 201 bp, Artificial Sequence
  Synthetic polynucleotide
aatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagtttacttaaatcatggtattggtgt

SEQ ID NO: 11195 - DNA, 201 bp, Artificial Sequence
  Synthetic polynucleotide
ttttcatttcctcattggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttg

SEQ ID NO: 11196 - DNA, 201 bp, Artificial Sequence
  Synthetic polynucleotide
cgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggc

SEQ ID NO: 11197 - DNA, 208 bp, Artificial Sequence
  Synthetic polynucleotide
tagaaaggctggggtgttgggctcatggattgggtcatgtgggcccattttaccttttgaagtattgctcccccagtggattgggtggctccattcactccaatgctgagcacttccacagagtgggttaaagcggctccgaacacgaaacgtgtagcgtttctgcccatccacactaggcaaggagaacttatgtctataatccact

SEQ ID NO: 11198 - DNA, 201 bp, Artificial Sequence
  Synthetic polynucleotide
gtgtttgtgacactcttgtgaccgtgccaagaaaacgtaagcaaatatcaagcctccaaatcctaatgcaacaagtcctgaatcccttgcaggtatgtcctggatgatgaatacacaagctcagtaggctccaaatttccagtccggtggtccccaccggaagtcctgatgtatagcaagttcagcagcaaatctgacatt

SEQ ID NO: 11199 - DNA, 201 bp, Artificial Sequence
  Synthetic polynucleotide
ggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgctttt

SEQ ID NO: 11200 - DNA, 201 bp, Artificial Sequence
  Synthetic polynucleotide
tcaagcacttagcaagcccctggcacttgataaagcttagtaaatatagctaattgtggtgacactcttcttcaatttatcaaggcaccaaaaacccctctgcagaagagcatggacctcttaggaaaacaactttccttttactcctttggtataataggtaagagaagagtgagtatgtatatatttttatttgagttt

SEQ ID NO: 11201 - DNA, 201 bp, Artificial Sequence
  Synthetic polynucleotide
caataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaag

SEQ ID NO: 11202 - DNA, 201 bp, Artificial Sequence
  Synthetic polynucleotide
gcaaaatagcccagtataagcgggagtgcccgtccatctttgcttgggaaatccgagacagattactgtccgagggggtctgtaccaacgataacataccaagcgtaagttcattgagaacatctgccctccctgccctaagcccaatgctctctcctctttacctcctcccaccctctctctccactgtctcttagtctg

SEQ ID NO: 11203 - DNA, 201 bp, Artificial Sequence
  Synthetic polynucleotide
gtagctgttgtttttaactttttattccaaaatacggctgttccaaaaaatcttgaccttgatattttttcttctagtccttcttggaatggccttggaagcatccctagcacagatatctacaaaagtaccaagaattacaaaaacgtaagtacctttgtgagacatttgctggacttgggtttactagcctgaagtttc

SEQ ID NO: 11204 - DNA, 203 bp, Artificial Sequence; identical to SEQ ID NO: 11180
  Synthetic polynucleotide

SEQ ID NO: 11205 - DNA, 203 bp, Artificial Sequence
  Synthetic polynucleotide
ccttcactactctgctaccagataaataacaggagatttaacaatcatcacatggaaaaccattccctgaataacacagccttctctgtctctcttggcagtcggtcttggcagctgttgtaattgccaacctgaaagggatgtttatgcagctgtgtgacattcctcgtctgtggagacagaataagattgatgctgtaagt

SEQ ID NO: 11206 - DNA, 201 bp, Artificial Sequence; identical to SEQ ID NO: 11017
  Synthetic polynucleotide

SEQ ID NO: 11207 - DNA, 204 bp, Artificial Sequence
  Synthetic polynucleotide
aacaccgagctcaggttggaatgatctaaggacacaaaagcatggggcctcggggctggggcggtgcgactaccggaggcgcaagttgcgcacggggtcccgggagcgatacactgcctccccggtgtcagtgctccagacggtctccgccatgacagctgcgacgcgccgcgactgcgccggaaagcgcgccgctctgttttc

SEQ ID NO: 11208 - DNA, 201 bp, Artificial Sequence; identical to SEQ ID NO: 11013
  Synthetic polynucleotide

SEQ ID NO: 11209 - DNA, 201 bp, Artificial Sequence
  Synthetic polynucleotide
cagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggct

SEQ ID NO: 11210 - DNA, 212 bp, Artificial Sequence; identical to SEQ ID NO: 11101
  Synthetic polynucleotide

SEQ ID NO: 11211 - DNA, 201 bp, Artificial Sequence
  Synthetic polynucleotide
atgtggaggatgaggtgggaggagggacggcagccctgcttctcttctgcccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatgctgggccagtgaga

SEQ ID NO: 11212 - DNA, 201 bp, Artificial Sequence; identical to SEQ ID NO: 11008
  Synthetic polynucleotide

SEQ ID NO: 11213 - DNA, 201 bp, Artificial Sequence
  Synthetic polynucleotide
aagtgccgttaggccaagcaggtgctaaaagcccggggtcgtggaccccggccaggtcttagcagcatggaggcgcagggtgtagcggagggcgcggggccgggcgccgccagcggcgtgccccaccccgcggccctagccccggctgcggctcccaccttggcgccagcctcggtggcggccgcggcctctcaattcacc

SEQ ID NO: 11214 - DNA, 201 bp, Artificial Sequence
  Synthetic polynucleotide
gtgttcattgcaggaagagtaaataaaggtggtattttgattagaagtgccagaggaattttcttctggatttttgcaaatggatcttacagggttacaggtgatttaggtaactgactttttttttttttaatagcatatgacttatgggctatgttactttgagcacctacttgttatttgtgggagtgataaaaagaa

SEQ ID NO: 11215 - DNA, 206 bp, Artificial Sequence; identical to SEQ ID NO: 10880
  Synthetic polynucleotide

SEQ ID NO: 11216 - DNA, 201 bp, Artificial Sequence
  Synthetic polynucleotide
atcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaaggtgtgcagctagcaggctgaa

SEQ ID NO: 11217 - DNA, 201 bp, Artificial Sequence
  Synthetic polynucleotide
aaaaacagttatgaaaactggatctgcaggcctttcaggccaccatagagcacctagttacagtggtttatccatggtttctggagtgaaacagggatctggtcctgctcctaccactcataaggtattctgggacagtaactttaattgctgtctttttgcaaatagaaaaatttttaagatactattcctgcttaagtt

SEQ ID NO: 11218 - DNA, 201 bp, Artificial Sequence
  Synthetic polynucleotide
ggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggtgagtggggaggccgagggcgccc

SEQ ID NO: 11219 - DNA, 201 bp, Artificial Sequence
  Synthetic polynucleotide
ttatcgtcgtctgtcttttcctgggcctttgcgatggcttcttcatcaccatcatggcccccattgcatttgagctggtgggcccaatgcaggcctcacaggccattggctacctcctgggcatgatggccctgccaatgattgctgggccccccattgcaggtgaggctgatattccagggagggcatgaatcagggagt

SEQ ID NO: 11220 - DNA, 201 bp, Artificial Sequence
  Synthetic polynucleotide
aggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggca

SEQ ID NO: 11221 - DNA, 201 bp, Artificial Sequence; identical to SEQ ID NO: 10933
  Synthetic polynucleotide

SEQ ID NO: 11222 - DNA, 203 bp, Artificial Sequence
  Synthetic polynucleotide
acctatcggccgtgctgggtctcagcgaggagagtctgcagtgccggcgcaggcagcgcggggacgcggggtccccttggggctgcccgctgtgccccgaccgtggccccgcagaggcgcagacgcaggcggaggggcaggggcaagggcaggggcaggggcaggggcaagggcaggggcaaggacaggggcaaggacagggg

SEQ ID NO: 11223 - DNA, 201 bp, Artificial Sequence
  Synthetic polynucleotide
gagagaaggaggccaagagaaaccgcaccttcgtcctcaacttcatcaagattcccgtggtcccgcacaatgagtgcagcgaggtcatgagcaacatggtgtctgagaacatgctgtgtgcgggcatcctcggggaccggcaggatgcctgcgagggcgacagtggggggcccatggtcgcctccttccacggcacctggt

SEQ ID NO: 11224 - DNA, 201 bp, Artificial Sequence; identical to SEQ ID NO: 11005
  Synthetic polynucleotide

SEQ ID NO: 11225 - DNA, 201 bp, Artificial Sequence
  Synthetic polynucleotide
tgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcag

SEQ ID NO: 11226 - DNA, 201 bp, Artificial Sequence
  Synthetic polynucleotide
gaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagac

SEQ ID NO: 11227 - DNA, 201 bp, Artificial Sequence
  Synthetic polynucleotide
aagaacgaggaactgcgtctttatcaccatctcttcaacaactatgacccaggaagccggccagtgcgggagcctgaggatactgtcaccatcagcctcaaggtcaccctgacgaatctcatctcactggtaagctacccccaccctcatcttaagccaaaaatcccacttctggccccaaccgctgagctctgtcctaaa

SEQ ID NO: 11228 - DNA, 206 bp, Artificial Sequence; identical to SEQ ID NO: 11087
  Synthetic polynucleotide

SEQ ID NO: 11229 - DNA, 201 bp, Artificial Sequence
  Synthetic polynucleotide
cccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcg

SEQ ID NO: 11230 - DNA, 205 bp, Artificial Sequence
  Synthetic polynucleotide
accaatgtcatgcctcaagatcttgatgatgtttgtcagagcaggcaggctacgtttatccaaatgggtgaaaaattcatactcatctttctttaaacgagaaggtctagattcaatgtgggtcaggtttacatcattctcctagaagagagaatggggagggtgaggagacagtcactggaactaacgcaggccaaagatgcag

SEQ ID NO: 11231 - DNA, 201 bp, Artificial Sequence
  Synthetic polynucleotide
atgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctc

SEQ ID NO: 11232 - DNA, 201 bp, Artificial Sequence
  Synthetic polynucleotide
cccccgtgccccacagatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagc

SEQ ID NO: 11233 - DNA, 201 bp, Artificial Sequence
  Synthetic polynucleotide
tccctttcctctccttgagactaatgcccccacccccacccccaccccacctaccggacagatgaacagtttctgctgcagcggctggcagacggggccatcgacctctatgccatggtggtggttctctcgaggtgaggaggcaggcagggaatgcctgagccgcagggggcctgggcctggatcccagccggcccagat

SEQ ID NO: 11234 - DNA, 201 bp, Artificial Sequence
  Synthetic polynucleotide
gccgcctcccaaaggtgccacatactgctctctctttctcctccaggaagtccataggactgtcttcatgcgcttgaacatcatcagccctgacctgtctggtgagctccctccaggtctctcgggtttgttctagtggctgaggtcacagtagggcacagcgggcagccctgagaaacggcctgggcacatagcacatgg

SEQ ID NO: 11235 - DNA, 201 bp, Artificial Sequence
  Synthetic polynucleotide
tgtagagaggagggcgtgtgcaaggagtggggccaggagcggggctggacactgctggctccacacaggggcccagcagggagctcgtatgccgctcgtgcctgaagcagacgctgcacaagctggaggccatgatgctcatcctgcaggcagagaccaccgcgggcaccgtgacgcccaccgccatcggagacagcatcc

SEQ ID NO: 11236 - DNA, 201 bp, Artificial Sequence; identical to SEQ ID NO: 11044
  Synthetic polynucleotide

SEQ ID NO: 11237 - DNA, 201 bp, Artificial Sequence; identical to SEQ ID NO: 10728
  Synthetic polynucleotide

SEQ ID NO: 11238 - DNA, 201 bp, Artificial Sequence
  Synthetic polynucleotide
cactcgggcctgtccccacaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttcttt

SEQ ID NO: 11239 - DNA, 201 bp, Artificial Sequence; identical to SEQ ID NO: 11233
  Synthetic polynucleotide

SEQ ID NO: 11240 - DNA, 201 bp, Artificial Sequence; identical to SEQ ID NO: 11171
  Synthetic polynucleotide

SEQ ID NO: 11241 - DNA, 201 bp, Artificial Sequence
  Synthetic polynucleotide
catttctgttttcctgtagcaaaaccagaaatcctgacttacgacaggctcgtgaatggcatgctccaatgtgtggcagcaggattcccagagcccacaatagattggtatttttgtccaggaactgagcagaggtgagatgattatttttggcactgcttataatgcagaggggaaggactgcaattcacttgaatttca

SEQ ID NO: 11242 - DNA, 213 bp, Artificial Sequence; identical to SEQ ID NO: 11122
  Synthetic polynucleotide

SEQ ID NO: 11243 - DNA, 201 bp, Artificial Sequence
  Synthetic polynucleotide
ggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagtatct

SEQ ID NO: 11244 - DNA, 201 bp, Artificial Sequence
  Synthetic polynucleotide
ctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatg

SEQ ID NO: 11245 - DNA, 201 bp, Artificial Sequence
  Synthetic polynucleotide
cttactgatcgattactacttttccctccccatagttaccgtacacgagaagaaattcaggaagtaagaagtaagagtgaccctattatgcttctcaaggacaggatggtgaacagcaatcttgccagtgtggaagaactaaaggtacagtcacttgttcatggtggtttgaaggttggctttaaaagttgccacccctgg

SEQ ID NO: 11246 - DNA, 201 bp, Artificial Sequence
  Synthetic polynucleotide
gttgttgttgattggaatcgaggagctacaactttaatatatacccatgcctctagtaagaccagaaaagtagccatggtcttgaaggaatttattgaccagatgttggtaagagaattctcttagatgattcagagctaagttgaaactggcccattatctgagggcttaaagccaagagatagctacagtgagcaggag

SEQ ID NO: 11247 - DNA, 201 bp, Artificial Sequence
  Synthetic polynucleotide
agagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctgg

SEQ ID NO: 11248 - DNA, 201 bp, Artificial Sequence
  Synthetic polynucleotide
tacgtgttccaaggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtggga

SEQ ID NO: 11249 - DNA, 201 bp, Artificial Sequence
  Synthetic polynucleotide
tttacaaagcgggttctaggagagagtggagagatggatgctctacgaatacagatggaagagcgattcatggcttccaatccttccaaggtctcctatcagccaatcactactactttaaaacgaaaacaagaggaagtatctgctgtcattattcagcgtgcttacagacgccaccttttaaagcgaactgtaaaacaa

SEQ ID NO: 11250 - DNA, 201 bp, Artificial Sequence
  Synthetic polynucleotide
gcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcacc

SEQ ID NO: 11251 - DNA, 205 bp, Artificial Sequence
  Synthetic polynucleotide
agcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgcca

SEQ ID NO: 11252 - DNA, 201 bp, Artificial Sequence
  Synthetic polynucleotide
ttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcct

SEQ ID NO: 11253 - DNA, 203 bp, Artificial Sequence
  Synthetic polynucleotide
caccgacccacacgtttatctcaggcaggagggagccaaagtttctctgatgtctcctgatcagcttcggaacaagtttccctggataaacacagagggagtggctttggcgtcttatggtgaggcttgcttgcagaggggacagcttttttcctgaagatggagactaaggggtgctacacgttgggagtctcggtactcca

SEQ ID NO: 11254 - DNA, 201 bp, Artificial Sequence
  Synthetic polynucleotide
cgggtgagcacagtggccctggcccggggggccgcgcggggtgcctgccaggggggaggctcctaaggcccaccccggtgttttccccgccagctgccttctgccagagcctgggcgccgccgcccccgaggtccgctgctgtgtggatgccgtgaacttcgtggccgagagcacgagagatcaggaggccaccggcgagg

SEQ ID NO: 11255 - DNA, 201 bp, Artificial Sequence; identical to SEQ ID NO: 10898
  Synthetic polynucleotide

SEQ ID NO: 11256 - DNA, 204 bp, Artificial Sequence
  Synthetic polynucleotide
gaacaccgagctcaggttggaatgatctaaggacacaaaagcatggggcctcggggctggggcggtgcgactaccggaggcgcaagttgcgcacggggtcccgggagcgatacactgcctccccggtgtcagtgctccagacggtctccgccatgacagctgcgacgcgccgcgactgcgccggaaagcgcgccgctctgtttt

SEQ ID NO: 11257 - DNA, 201 bp, Artificial Sequence
  Synthetic polynucleotide
ctcccgtcacaagctcctgcctctcttttctccccatacaggacgggctctacgagtgcattctctgtgcctgctgtagcaccagctgccccagctactggtggaacggagacaaatatctggggcctgcagttcttatgcaggtgaggtgctccttaattgctttaagagaaattgaaactcaagcatccagaagtccaa

SEQ ID NO: 11258 - DNA, 201 bp, Artificial Sequence
  Synthetic polynucleotide
gcggagtgaatcagctcggtggtgtctttgtcaacgggcggccactgccggactccacccggcagaagattgtagagctagctcacagcggggcccggccgtgcgacatttcccgaattctgcaggtgatcctcccggcgccgccccactcgccgcccccgcggccctccactctcaacgccctctcttcatttcttactg

SEQ ID NO: 11259 - DNA, 201 bp, Artificial Sequence
  Synthetic polynucleotide
tttctgagaagcttcacgaggacaaggctgcagagccgggtgatgccctcgacctaatcattcacagtgcaagggagctgggccatgagccctccatgcaggagctgaaggtaggtgctgacaggccgctccttctcccctcttttgcattcccagcaggtccctacaccaatgctgcatccccagagccacatcttgtgt

SEQ ID NO: 11260 - DNA, 201 bp, Artificial Sequence; identical to SEQ ID NO: 11143
  Synthetic polynucleotide

SEQ ID NO: 11261 - DNA, 201 bp, Artificial Sequence
  Synthetic polynucleotide
ccatctcttcaacaactatgacccaggaagccggccagtgcgggagcctgaggatactgtcaccatcagcctcaaggtcaccctgacgaatctcatctcactggtaagctacccccaccctcatcttaagccaaaaatcccacttctggccccaaccgctgagctctgtcctaaagctcacttctggccctgaaatctcac

SEQ ID NO: 11262 - DNA, 201 bp, Artificial Sequence
  Synthetic polynucleotide
ggccgagcctgcctgcagtgagcgtcccactctgtccctgcaggagatcgtgctggtggtgttcttcgggacggagtacgtggtccgcctctggtccgccggctgccgcagcaagtacgtgggcctctgggggcggctgcgctttgcccggaagcccatttccatcatcggtgagtcatgcctgccctgtggaggtcacgc

SEQ ID NO: 11263 - DNA, 201 bp, Artificial Sequence
  Synthetic polynucleotide
acggagtttgcgtttgaggtagttgtgcctgaccttgccctcatccgcttcttggtggaagattatgatgcctcctccaagaatgacttcattggccagagtaccatccccttgaacagcctcaagcaaggtgagtgtcaagagaaggggatggccaaggtggtgggaagcagggcctggcgtctcttgggctggggctgg

SEQ ID NO: 11264 - DNA, 201 bp, Artificial Sequence
  Synthetic polynucleotide
tgaacagttcagtggaggatgccaagacatcaatgaatgtggctctgcgcaggccccctgcagctatggctgttccaataccgagggcggttacctgtgtggctgtccacctggttacttccgcataggccaagggtaagcagtgctcttcctggtcatggttggagattctttcattcgtaatataattaagtatactga

SEQ ID NO: 11265 - DNA, 207 bp, Artificial Sequence; identical to SEQ ID NO: 11107
  Synthetic polynucleotide

SEQ ID NO: 11266 - DNA, 201 bp, Artificial Sequence
  Synthetic polynucleotide
agacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcat

SEQ ID NO: 11267 - DNA, 201 bp, Artificial Sequence; identical to SEQ ID NO: 10791
  Synthetic polynucleotide

SEQ ID NO: 11268 - DNA, 201 bp, Artificial Sequence
  Synthetic polynucleotide
ttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatg

SEQ ID NO: 11269 - DNA, 201 bp, Artificial Sequence
  Synthetic polynucleotide
gcgctaacgcctgcccttgctctgcccctgcccttctccccagtgggccccaccatcctgaataagattgaagcggctctgaccaaccagaacctgtctgtggatgtggtggaccagtgcctcgtctgcctcaaggaggagtggatgaagtaagcaacagtgtgggtgaggcccctttgcttgcgaccctggagaaaacct

SEQ ID NO: 11270 - DNA, 212 bp, Artificial Sequence
  Synthetic polynucleotide
aaccagcccctgggagcagctgccctgtcccccagggcccagggctgcctcacctccaaagtaggagccgtcggccagcttggtctccttgttgcccttggtgagcacgctgaccacgccatgctggatgaagtacatcttcttgccaatggtgccttcccggatgatgtagtccccaggctggaagacctcgaaacgcagcttggtcagca

SEQ ID NO: 11271 - DNA, 201 bp, Artificial Sequence
  Synthetic polynucleotide
gtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatttaggtgc

SEQ ID NO: 11272 - DNA, 201 bp, Artificial Sequence
  Synthetic polynucleotide
tcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcat

SEQ ID NO: 11273 - DNA, 201 bp, Artificial Sequence
  Synthetic polynucleotide
ttctccatgctggctgctggggtcatgcacgcagtagccacggcctgcagcctgggcaagctggtgagctgtggctgtggctggaagggcagtggtgagcaggatcggctgagggccaaactgctgcagctgcaggcactgtcccgaggcaagagtttcccccactctctgcccagccctggccctggctcaagccccagc

SEQ ID NO: 11274 - DNA, 203 bp, Artificial Sequence
  Synthetic polynucleotide
cctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttg

SEQ ID NO: 11275 - DNA, 204 bp, Artificial Sequence; identical to SEQ ID NO: 11079
  Synthetic polynucleotide

SEQ ID NO: 11276 - DNA, 201 bp, Artificial Sequence
  Synthetic polynucleotide
aaccatttcataacagggaccaaagaattgaaccccgatccggttcacagaaaaataaactgctcacccgtctccacctgtcagtttcagggagaccttgcatcaccatggggagtgtgataccagatggggccaaatgggatgatgactgtaatacctgccagtgcctgaatggacggatcgcctgctcaaaggtaggac

SEQ ID NO: 11277 - DNA, 201 bp, Artificial Sequence; identical to SEQ ID NO: 11171
  Synthetic polynucleotide

SEQ ID NO: 11278 - DNA, 201 bp, Artificial Sequence; identical to SEQ ID NO: 10742
  Synthetic polynucleotide

SEQ ID NO: 11279 - DNA, 201 bp, Artificial Sequence
  Synthetic polynucleotide
gctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacg

SEQ ID NO: 11280 - DNA, 201 bp, Artificial Sequence
  Synthetic polynucleotide
cataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggt

SEQ ID NO: 11281 - DNA, 201 bp, Artificial Sequence
  Synthetic polynucleotide
gggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgcca

SEQ ID NO: 11282 - DNA, 201 bp, Artificial Sequence
  Synthetic polynucleotide
cgtgctcccggctacctttgtgtttttggctctgatgctttctattgttatccctccttttggcgaataccccgctttgacccttcacccctggatatatgggcagcagtacaccttcttcaggtgcgcggactcggggtcaccattctcctctgtgggtttggggcacctgggtcacatgctgcttagaagggccctgac

SEQ ID NO: 11283 - DNA, 201 bp, Artificial Sequence
  Synthetic polynucleotide
ccagaactcagtttagatactgggacactggagaaaaagtcaggagcttgtgaagatcatagtatggctcaagctggtgaagtcgtgctgaagatgaaagtggaagggatgacctgccattcatgtactagcactattgaaggaaaaattgggaaactgcaaggtgttcagcgaattaaaggtaatgtgtctggtgttgat

SEQ ID NO: 11284 - DNA, 201 bp, Artificial Sequence; identical to SEQ ID NO: 11233
  Synthetic polynucleotide

SEQ ID NO: 11285 - DNA, 203 bp, Artificial Sequence
  Synthetic polynucleotide
gttacggctgtctccacccctcagggctaaggtgccctgaggcagagggccaagtcactcacctggactgctgcagacagtgcaagcggaaggtgacagtgcctgtggtctctgtgcggagtccaaagcggctcaggcgttccccctgtggcatgccattgggacagcctcaggtttctgctctctctagacacccccgcacc

SEQ ID NO: 11286 - DNA, 203 bp, Artificial Sequence
  Synthetic polynucleotide
ctgaccccccgcgcgcgaggcagcgatgacgtgggccctgccctcccacgccccattccccttccctgaggccaccgccccctccttgcaggtccagcaaccacggcatcagcctgcaggagatcccacccgagcggcgacggaagctggagaaggcgcggccgggccagttctcttgagaagtgaggcccggccccggacag

SEQ ID NO: 11287 - DNA, 201 bp, Artificial Sequence
  Synthetic polynucleotide
ggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctgtgagtagcgggcccagcggcacccgggagaggccgcgggacgggcgggcg

SEQ ID NO: 11288 - DNA, 201 bp, Artificial Sequence
  Synthetic polynucleotide
ggaagcagagtcattgtgaccagaggggtttgtgtggctgaagaggcaggaggaacagtgtatccacagcgtgggaccatgccaggcacaaaacggtttcaacatgtcattgagaccccggagcctggcaagtgggaggtgagaccccttcttcatgttggctttctgtgctgattcctagaattatttttcatccagtct

SEQ ID NO: 11289 - DNA, 212 bp, Artificial Sequence; identical to SEQ ID NO: 11101
  Synthetic polynucleotide

SEQ ID NO: 11290 - DNA, 201 bp, Artificial Sequence
  Synthetic polynucleotide
acctgggagaagacgcccgcttccgcatgttcagcaagcagggagtgttgactctggagattagaaagccctgcccctttgacgggggcatctatgtctgcagggccaccaacttacagggcgaggcacggtgtgagtgccgcctggaggtgcgaggtgaggagccctcggggccagggcctgggagatgggaagagcggg

SEQ ID NO: 11291 - DNA, 201 bp, Artificial Sequence
  Synthetic polynucleotide
agatttttctccctccagacgtgccgggcctgcagtgcgtgaagtacattcagggactccagtggggaactcagcaaatactcagtgaacacaccaggatgacgcaccaagggccccatgacagattcatcgaacttaatagtacccttttcctgctgagattcatcaatgccaatgtcattgctgaactgttcttcaggc

SEQ ID NO: 11292 - DNA, 204 bp, Artificial Sequence
  Synthetic polynucleotide
ttctcagttttgtacccattaattaaaacaaattatcttcatcaatttattcagcgaataggtcatggtgataaaaaccacaccgatgctgaccgttctcctatttttctccagtttattgattgtgtgtggcaaatgtcaaaacaggtaaggaatatgagggatgaaaatacattcaactcattgtttaaattaaacatttta

SEQ ID NO: 11293 - DNA, 208 bp, Artificial Sequence
  Synthetic polynucleotide
ccaggcgcccggcggggcagcgcgggcctggccaagaagtgccccttctcgctggagctggcggagggcggcccggcgggcggcgcgctctacgcgcccatcgcgcccggcgccccaggtcccgcgccccctgcgtccccggccgcgcccgccgcgcccccagttgcctccgaccttggcccgcggccgccggtgagcctagacccgc

SEQ ID NO: 11294 - DNA, 202 bp, Artificial Sequence
  Synthetic polynucleotide
cctgtgtgattgctgttttaagttcgataccttgtctccaatccactctaagatgtcagcacactcctgtacatactgctggaacttcagggcccgcagcaactggtcacccttctccagggtcagctctaacagcaggtcccacaggtggcgtagctcctctatatgggcctttaggaaagaggggcaaaaccactcagcc

SEQ ID NO: 11295 - DNA, 208 bp, Artificial Sequence
  Synthetic polynucleotide
gaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggtacccgggagggctgtgggccaggctcagcccagagcagggggaggaaaagacacagt

SEQ ID NO: 11296 - DNA, 214 bp, Artificial Sequence
  Synthetic polynucleotide
gcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggc

SEQ ID NO: 11297 - DNA, 201 bp, Artificial Sequence
  Synthetic polynucleotide
ccttcttctccctcttcttcctcttcactctgctctcttctcttcttttcccctttcctctcctctccctttcctcaggtcacagcggagtgaatcagctcggtggtgtctttgtcaacgggcggccactgccggactccacccggcagaagattgtagagctagctcacagcggggcccggccgtgcgacatttcccgaa

SEQ ID NO: 11298 - DNA, 201 bp, Artificial Sequence
  Synthetic polynucleotide
ccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatcc

SEQ ID NO: 11299 - DNA, 201 bp, Artificial Sequence; identical to SEQ ID NO: 11279
  Synthetic polynucleotide

SEQ ID NO: 11300 - DNA, 201 bp, Artificial Sequence
  Synthetic polynucleotide
catcctgttcatccgggccgctcgccgcgtgcattcaggcacttaccaggtgacggtgcgcattgagaacatggaggacaaggccacgctggtgctgcaggttgttggtgcgtggccaaggcctccttgagcccccttgtttcccttccctgggctgggctgctggggccaagggtggggccaggggacccaacccacagc

SEQ ID NO: 11301 - DNA, 201 bp, Artificial Sequence
  Synthetic polynucleotide
gactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggc

SEQ ID NO: 11302 - DNA, 201 bp, Artificial Sequence
  Synthetic polynucleotide
attccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaagg

SEQ ID NO: 11303 - DNA, 202 bp, Artificial Sequence
  Synthetic polynucleotide
ttccttaaagaagtaatgctgatccaggcttttttctttttctgtgactctttgacacgtaataatattgacttttctttctttccagacactacaacaacaggagtgcaaacttctctacagccgaaaagagggtcaaaggcaagaaaacaaaaacaaaaatagatataaaaacatcctgccctgtaagtatcaatattcc

SEQ ID NO: 11304 - DNA, 201 bp, Artificial Sequence
  Synthetic polynucleotide
accgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatata

SEQ ID NO: 11305 - DNA, 201 bp, Artificial Sequence
  Synthetic polynucleotide
ctgtgtgccctgctccaggtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggtatgggagacatttgaagcaaaaactttgtgaaaaaacaaccca

SEQ ID NO: 11306 - DNA, 201 bp, Artificial Sequence
  Synthetic polynucleotide
aaaacctggctggttgggaacaagcttgtcactgtgacgacaagcgtgggaaccgggacccggtcgttactaggcctggactcgggggagctgcagtccggcccggagtcgaggtgactgcaccttcctttcctccgcgcctgccagcctcgacaccggctgtcccgagcccaggcccacgtggcaccctcgtaccagcct

SEQ ID NO: 11307 - DNA, 201 bp, Artificial Sequence; identical to SEQ ID NO: 10907
  Synthetic polynucleotide

SEQ ID NO: 11308 - DNA, 201 bp, Artificial Sequence
  Synthetic polynucleotide
agccattggggaagagcctccccaccaagcctctttctctctcttccagatatcgatgagtgtcaggatcccgacacctgcagccagctctgcgtgaacctggagggtggctacaagtgccagtgtgaggaaggcttccagctggacccccacacgaaggcctgcaaggctgtgggtgagcacgggaaggcggcgggtggg

SEQ ID NO: 11309 - DNA, 211 bp, Artificial Sequence
  Synthetic polynucleotide
gacaaggcgcggctgagccccgacccccggggccgcccctgagccccgcctctccctccccggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtg

SEQ ID NO: 11310 - DNA, 201 bp, Artificial Sequence; identical to SEQ ID NO: 11094
  Synthetic polynucleotide

SEQ ID NO: 11311 - DNA, 201 bp, Artificial Sequence
  Synthetic polynucleotide
gtgtctccagccgtgagctggtgaagaaggtctccgatgtcatatggaacagcctcagccgctcctacttcaaggatcgggcccacatccagtccctcttcagcttcatcacaggttggagcccagtaggtgggaatcttatccatgacccacttcttcaaaaccctccatggtttacagaacccttttaagaactgtaag

SEQ ID NO: 11312 - DNA, 214 bp, Artificial Sequence
  Synthetic polynucleotide
ctgtgtgcaatgtagggggtcatgaactttgaaggatccactttcttccggatgaccttcctcctctccaccggctttgctgatgctggctgtgccagtgctggctgtgccagagctggtttggaagtttctgattgctcatagtcagatgtccttgttgtcgtagtctcataaatttttgttattgtctgaaaatttgatatgcagttcaaca

SEQ ID NO: 11313 - DNA, 201 bp, Artificial Sequence
  Synthetic polynucleotide
gggcagggatggggcaggaggcaggggcaagatggaggcctgggggaacaaggctgtctcccatctcatctgacttctcttggtttggttgtcagggcccccgtggcctgcctggtgagagaggtcgccctggagcccctggccctgctgtaagtactcctggccccttgggggatccctgagctctggaaggggctcccc

SEQ ID NO: 11314 - DNA, 201 bp, Artificial Sequence
  Synthetic polynucleotide
ctggagtgtcgagtccctcagccttgcaattctggggtggagggaagagtgggcagcccacccacccactttctcctggcagccaacagcatgattgacaggaagccgcgcctgctcttccccaccaactccagcagccacctggtggccttgcaggggcagccattggtcctggagtgcatcgccgagggcttgtgagtc

SEQ ID NO: 11315 - DNA, 202 bp, Artificial Sequence
  Synthetic polynucleotide
atggggagagacagcccttgctgagcagatcccgtccttgccctctcccagggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgg

SEQ ID NO: 11316 - DNA, 201 bp, Artificial Sequence
  Synthetic polynucleotide
gctgtggactgagttacctttgtgtcctgtgttggttccacagggattgtgtgcacactctgcattccagggacacgtggctgaagaaagcaagagtggtgaggcttggagaagtaccctacaaggtaactggagctggggggtccctgtggggagtggtgacacaggcctgtagctgagcgggagagctgggggcagaga

SEQ ID NO: 11317 - DNA, 201 bp, Artificial Sequence
  Synthetic polynucleotide
ctgttatcttctctcctaggctgacacaggcaagaatttagtcacgctccccaatacaactgccactgcaattctgtgcagtgacgagactatctggctggagcctgaagttctcttttcagggcctcgtcaaggtgagatgatctagagaaaacttcacacgggagtgaacaaatgtttctttcaaagagattaagagtt

SEQ ID NO: 11318 - DNA, 201 bp, Artificial Sequence
  Synthetic polynucleotide
atttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggc

SEQ ID NO: 11319 - DNA, 201 bp, Artificial Sequence
  Synthetic polynucleotide
ccgcaaccacacctacaatacctatatcgggcagggttacatcatccccgggatggaccaggggctgcagggtgcctgcatgggggaacgccggagaattaccatccccccgcacctcgcctatggggagaatggaactggtaggggcgttccccagccaccacctcagctcctcctccgaactgcccattgtgtctaggc

SEQ ID NO: 11320 - DNA, 201 bp, Artificial Sequence
  Synthetic polynucleotide
cgcctggtgcccttctccagccccaggccccccggagagccgccgggtggggagcccctgatggaggactgcgagaagagcagcgacacttgcaaccccctgtcaggtatcccgggcgacgggcgggcgagggaggaccgggcgtggcagcggtggtgcgtctaccccgctcacccagctctgctctctggctgcaggcgc

SEQ ID NO: 11321 - DNA, 201 bp, Artificial Sequence; identical to SEQ ID NO: 11095
  Synthetic polynucleotide

SEQ ID NO: 11322 - DNA, 201 bp, Artificial Sequence
  Synthetic polynucleotide
gggagaagtgggagctggacctggacatcaaggaggtcttcgtccaccccaactacagcaagagcaccaccgacaatgacatcgcactgctgcacctggcccagcccgccaccctctcgcagaccatagtgcccatctgcctcccggacagcggccttgcagagcgcgagctcaatcaggccggccaggagaccctcgtga

SEQ ID NO: 11323 - DNA, 201 bp, Artificial Sequence
  Synthetic polynucleotide
atagtaggggtggagatgccaagggcacccaggagaggctctcggcatcaggaagggcctggcccagagatgcctcccctccctccctgcccccaggagtggttcaccgtcttggagcattaccgccgcacccactgcgtggtgccagagctcatcattggcaatggctactacttccgcgtcttcagccagaatatggtt

SEQ ID NO: 11324 - DNA, 201 bp, Artificial Sequence
  Synthetic polynucleotide
acctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatg

SEQ ID NO: 11325 - DNA, 201 bp, Artificial Sequence
  Synthetic polynucleotide
gcctaagtgtcttccccggaggtgagattatctccgcctgtgctggacacctccctttctcctgcagccatggatgccgctctgctcctgaacgtggaaggggtcaagaaaaccattctgcacgggggcacgggcgagctcccaaacttcatcaccggatcccgagtgagtggggcccctccggagcagacagggtccccc

SEQ ID NO: 11326 - DNA, 201 bp, Artificial Sequence
  Synthetic polynucleotide
tatgagtaaccagagtcttattcttcctcatctccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaaga

SEQ ID NO: 11327 - DNA, 201 bp, Artificial Sequence
  Synthetic polynucleotide
agacagtccccgctacaaccccagccctcccaagactggggctaccgtctgaccctgcaagccccctcaggtgttcaccacatcaagcgccgggacatcgtgctcaagtgggagctgggggagggcgcctttgggaaggtcttccttgctgagtgccacaacctcctgcctgagcaggacaagatgctggtggctgtcaag

SEQ ID NO: 11328 - DNA, 201 bp, Artificial Sequence
  Synthetic polynucleotide
ttttcttattcccacagtgtatcggctagcctatctccggctaaatacactttgtgaacgccttctgtctgagcacccagaattagaacatatcatctggacccttttccagcacaccctgcagaatgagtatgaactcatgagagacaggcatttggaccaagtaagaaaatcaagcacttcaccttctctcctccctac

SEQ ID NO: 11329 - DNA, 201 bp, Artificial Sequence
  Synthetic polynucleotide
gcccgcccattgctgccctactggctgctggtgttcctggctgccctcaatgccctgctgcagtggctgctgcggccactggtgctctacgcacccctgctgaacccctacacgctggccgtggccaacaccaccttcaccgtcagcaccgacaaggctcagcgccatttcggctatgagcccctgttctcgtgggaggat

SEQ ID NO: 11330 - DNA, 201 bp, Artificial Sequence
  Synthetic polynucleotide
accctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaat

SEQ ID NO: 11331 - DNA, 201 bp, Artificial Sequence
  Synthetic polynucleotide
aaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatct

SEQ ID NO: 11332 - DNA, 205 bp, Artificial Sequence
  Synthetic polynucleotide
caggagagtggctcagcagctctggaacctgcagcccccctgccccgccacagtccgcttctggctgaccccgccggctttcccggcgcaggtactacgagaccggcagcatcaagccgggtgtgatcggtggctccaagcccaaagtggcgacgcccaaagtggtggacaagattgctgaatacaaacgacagaacccgactat

SEQ ID NO: 11333 - DNA, 208 bp, Artificial Sequence; identical to SEQ ID NO: 10975
  Synthetic polynucleotide

SEQ ID NO: 11334 - DNA, 201 bp, Artificial Sequence; identical to SEQ ID NO: 10782
  Synthetic polynucleotide

SEQ ID NO: 11335 - DNA, 205 bp, Artificial Sequence
  Synthetic polynucleotide
ttctcgccctgcaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtacgcaccgccccg

SEQ ID NO: 11336 - DNA, 201 bp, Artificial Sequence
  Synthetic polynucleotide
cctggcctctggaaagtccatgccccatcctcctgcagccctgcccttccctccccatctcgctcattcccccttctcttctttgaggtgtgcccggccggggcaggcgccctggagcctggcgccccaggcagctgctacctggatgcagggctgcggcggcgcctgcgggaggagtggggcgtgagctgctggaccctg

SEQ ID NO: 11337 - DNA, 201 bp, Artificial Sequence
  Synthetic polynucleotide
gggcgtgtggagcggccccgtggtaatctctcttctaccactttttcatgccttgcagcactttgcccatagggaggaaggggaagtgccccagctcgctgtacatggcctggctggagaccctgtcccaggacctcagacctccagtcatcctgatccgaggaaaccaggaaaacgtgctcaccttttactgccagtaac

SEQ ID NO: 11338 - DNA, 201 bp, Artificial Sequence; identical to SEQ ID NO: 11171
  Synthetic polynucleotide

SEQ ID NO: 11339 - DNA, 201 bp, Artificial Sequence
  Synthetic polynucleotide
tgctactggcgacctgcgagttgtctcaggtaatgtgacctttgcccctggggaaaccattcaaaccttgttgttagaggtcctggctgacgacgttccggagattgaagaggtgagaggactggctagtatagaatgacactgtaaatcataccgtatctatagtgactagaacagatggccattgtaacattttggaga

SEQ ID NO: 11340 - DNA, 201 bp, Artificial Sequence
  Synthetic polynucleotide
aagacggggaggtgggagggggacacgggaggtgagtcccgagctcacggcgtcccccaccgccacagcttaccgcatccacgtgaacttgagcactgtggggattctccgtgctctggactcgggctaccaggtggagctgcgaggccgcacggagctgaaggtgaggcagggccccaacccctcccggaggccccgccc

SEQ ID NO: 11341 - DNA, 201 bp, Artificial Sequence
  Synthetic polynucleotide
gaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaac

SEQ ID NO: 11342 - DNA, 201 bp, Artificial Sequence; identical to SEQ ID NO: 11085
  Synthetic polynucleotide

SEQ ID NO: 11343 - DNA, 208 bp, Artificial Sequence
  Synthetic polynucleotide
cagcgcgttcctgctcaggtccagctcccggagctcggccaggccgctgaagagcgcgggctgcaggtaggccagcctgttgcccgccagcaccagctcgcgcaggctgcccaggccgcggaacgccgcatcggggagcaccgccaggctattccagccgaggttgaggtcccagaggctgccgaggccctcgaagagcccgtcctcc

SEQ ID NO: 11344 - DNA, 201 bp, Artificial Sequence
  Synthetic polynucleotide
agcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgaccta

SEQ ID NO: 11345 - DNA, 201 bp, Artificial Sequence
  Synthetic polynucleotide
ctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggca

SEQ ID NO: 11346 - DNA, 201 bp, Artificial Sequence
  Synthetic polynucleotide
gccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgg

SEQ ID NO: 11347 - DNA, 201 bp, Artificial Sequence
  Synthetic polynucleotide
accgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctgg

SEQ ID NO: 11348 - DNA, 201 bp, Artificial Sequence; identical to SEQ ID NO: 11213
  Synthetic polynucleotide

SEQ ID NO: 11349 - DNA, 210 bp, Artificial Sequence; identical to SEQ ID NO: 11104
  Synthetic polynucleotide

SEQ ID NO: 11350 - DNA, 201 bp, Artificial Sequence
  Synthetic polynucleotide
gggtcttactacggagcacatttgcagtgaattgaggaatttgaatattttgaagaatgtttccgctgaatattcaatctacatcgcttgcgagccttccccttcagcgaacaatgaaatacatgtggccattgtaagtataagacccattcacacctcattattcgatggcaaggcagttcggttaaccagtgtctgaat

SEQ ID NO: 11351 - DNA, 201 bp, Artificial Sequence
  Synthetic polynucleotide
agaaacatacatgataataaagtttctggtccgttgtctggcaattcagctaatcatcatgctgataatcctagacatggttcaagtgaggactacctacacatggtgcacaggctaagtagtgacgtatgtaatatattatcattaaggtgataaaatagttctaatatttgtcatataacctagtatttccatttcaaa

SEQ ID NO: 11352 - DNA, 201 bp, Artificial Sequence
  Synthetic polynucleotide
atcttcagcaggctttgttgtgttaagtctcagcacatgttggatgggtggccatccagcggacatctccttcctgttgtttcagatacagccaggctgatgccctgaagtatgtcggcatcgaaagagaaatggaaatcccttgacatctgctacctcctcccccctcctctgaaacagctgccttagcttcaggaacct

SEQ ID NO: 11353 - DNA, 201 bp, Artificial Sequence
  Synthetic polynucleotide
gcgcccggtaatgaatgtggaggatgaggtgggaggagggacggcagccctgcttctcttctgcccagcttcaaggagcggttccatgccagcgtgcgcaggctgacgcccagctgcgagatcaccttcatcgagtcggaggagggcagtggccggggcgcggccctggtctcggcggtggcctgtaagaaggcctgtatg

SEQ ID NO: 11354 - DNA, 201 bp, Artificial Sequence
  Synthetic polynucleotide
ttccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctat

SEQ ID NO: 11355 - DNA, 206 bp, Artificial Sequence
  Synthetic polynucleotide
gtgggtctttcctttgagtgacagttcaatcctgtctcttctgtagtgtctgtcacctgcaaatccggggacttcagctgtgggggccgtgtcaaccgctgcattcctcagttctggaggtgcgatggccaagtggactgcgacaacggctcagacgagcaaggctgtcgtaagtgtggccctgcctttgctattgagcctatctg

SEQ ID NO: 11356 - DNA, 201 bp, Artificial Sequence
  Synthetic polynucleotide
cacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgca

SEQ ID NO: 11357 - DNA, 201 bp, Artificial Sequence
  Synthetic polynucleotide
accgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccaca

SEQ ID NO: 11358 - DNA, 201 bp, Artificial Sequence; identical to SEQ ID NO: 11148
  Synthetic polynucleotide

SEQ ID NO: 11359 - DNA, 201 bp, Artificial Sequence
  Synthetic polynucleotide
gggggctttggaggtggtgctggaggaggtgatggtggtattctgactgctaatgagaagagcaccatgcaggaactcaattctcggctggcctcttacttggataaggtgcaggctctagaggaggccaacaacgacctggagaataagatccaggattggtacgacaagaagggacctgctgctatccagaagaactac

SEQ ID NO: 11360 - DNA, 201 bp, Artificial Sequence
  Synthetic polynucleotide
tgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatcta

SEQ ID NO: 11361 - DNA, 201 bp, Artificial Sequence
  Synthetic polynucleotide
gaagagcctccccaccaagcctctttctctctcttccagatatcgatgagtgtcaggatcccgacacctgcagccagctctgcgtgaacctggagggtggctacaagtgccagtgtgaggaaggcttccagctggacccccacacgaaggcctgcaaggctgtgggtgagcacgggaaggcggcgggtgggggcggcctca

SEQ ID NO: 11362 - DNA, 201 bp, Artificial Sequence
  Synthetic polynucleotide
gcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgg

SEQ ID NO: 11363 - DNA, 211 bp, Artificial Sequence
  Synthetic polynucleotide
agagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacc

SEQ ID NO: 11364 - DNA, 201 bp, Artificial Sequence
  Synthetic polynucleotide
cgctcctcagtatacctcctgtcactgtcccttcaggactggagccgggcctcgtctttcttggcttcctcctggtggttgggatggggctggctggggccttcctggcccattatgtgaggtgagtagtggaatgaggtaagtaggaagtgagcttgtgccagaaatggaagtctgcagcaaaaacagcaggctgggttc

SEQ ID NO: 11365 - DNA, 201 bp, Artificial Sequence
  Synthetic polynucleotide
tgttctcatcctcttttctatagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgt

SEQ ID NO: 11366 - DNA, 201 bp, Artificial Sequence
  Synthetic polynucleotide
acccgtccccgcccgcagggggcgccctgctctggctcagcggacacgcggggactcaggcccagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagc

SEQ ID NO: 11367 - DNA, 204 bp, Artificial Sequence
  Synthetic polynucleotide
gtggaagtggctctcctgcgccttgcggaaggcgtagcagctctggccgtagtcgcggaaggtctgtagatctagctgcgccacgggctgggccgggccgggcagggggctaccaccccgcgccgcagaggggctctctgcgccgtctgagccggagctgggggactcgaacaggtcgcaaatgccggagtctcccgggagcgg

SEQ ID NO: 11368 - DNA, 207 bp, Artificial Sequence
  Synthetic polynucleotide
cggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagct

SEQ ID NO: 11369 - DNA, 208 bp, Artificial Sequence
  Synthetic polynucleotide
cccctcctcacttctgcctcacagtggccaggtcctgtgccagattgtccctctcaacctccagccgggcgctgttggcggtgagttgatcgagccgcagccgcagctctcgcagctcagcctggtagacgtctgccagcttggtgggctccttggcccgcagctggttcagctcagcagccagcgccttgttttgctgttccaggaa

SEQ ID NO: 11370 - DNA, 201 bp, Artificial Sequence
  Synthetic polynucleotide
cttaagaagggacggggccccacgctgcgcacccgcgggtttgctatggcgatgagcagcggcggcagtggtggcggcgtcccggagcaggaggattccgtgctgttccggcgcggcacaggccaggtgaggtcgcagccagtgcagtctccctattagcgctctcagcacccttcttccggcccaactctccttccgcag

SEQ ID NO: 11371 - DNA, 204 bp, Artificial Sequence
  Synthetic polynucleotide
cctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcgtgagtcctgcgttcgaccccaccccgtcccagccggggaccccggcccct

SEQ ID NO: 11372 - DNA, 201 bp, Artificial Sequence
  Synthetic polynucleotide
ccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaactt

SEQ ID NO: 11373 - DNA, 201 bp, Artificial Sequence
  Synthetic polynucleotide
cacgcccacaccacccacctgtgcccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatc

SEQ ID NO: 11374 - DNA, 201 bp, Artificial Sequence
  Synthetic polynucleotide
gaaagctaaactcacaatcacttctttttcagaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacaggtaagcaagggtatgggagctta

SEQ ID NO: 11375 - DNA, 201 bp, Artificial Sequence
  Synthetic polynucleotide
cacgggaggtgagtcccgagctcacggcgtcccccaccgccacagcttaccgcatccacgtgaacttgagcactgtggggattctccgtgctctggactcgggctaccaggtggagctgcgaggccgcacggagctgaaggtgaggcagggccccaacccctcccggaggccccgccctgtcctgaggcaccgcccatccc

SEQ ID NO: 11376 - DNA, 201 bp, Artificial Sequence
  Synthetic polynucleotide
gcagagggcagaggcctagcaactgcccctccccctgcagcagtggtgcgactatcgcctgcgctgggatccgcgagactacgaaggcctgtgggtgctgagggtgccgtccaccatggtgtggcggccggatatcgtgctggagaacaagtgaggagggggtgcaggcaggggtgtgggggacaaaggacacagggtctg

SEQ ID NO: 11377 - DNA, 201 bp, Artificial Sequence; identical to SEQ ID NO: 10734
  Synthetic polynucleotide

SEQ ID NO: 11378 - DNA, 201 bp, Artificial Sequence
  Synthetic polynucleotide
gtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcgtaagtaatgaccct

SEQ ID NO: 11379 - DNA, 201 bp, Artificial Sequence
  Synthetic polynucleotide
ctcgtaaaggaccgcaatgtggccaccccacgagactactactttgctctggcccataccgtgcgcgaccacctcgtggggcgctggatccgcacgcagcagcactactatgagaaggaccccaaggtgctgctggggagcctggggtgggggtatgggctgaaggcgctgccagggagctggcgatcttgacttaagtgg

SEQ ID NO: 11380 - DNA, 207 bp, Artificial Sequence
  Synthetic polynucleotide
cactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttca

SEQ ID NO: 11381 - DNA, 201 bp, Artificial Sequence
  Synthetic polynucleotide
ggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcaggtaag

SEQ ID NO: 11382 - DNA, 201 bp, Artificial Sequence
  Synthetic polynucleotide
ggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggc

SEQ ID NO: 11383 - DNA, 201 bp, Artificial Sequence
  Synthetic polynucleotide
tttggcggacatctcattcttacaggtctgctaggtcctaccatccaggctgaggtttatgatacagtggtcattacacttaagaacatggcttcccatcctgtcagtcttcatgctgttggtgtatcctactggaaagcttctgagggtgagtaaaataccctcctattgtcctgtcattctatgaatagaacagtgaga

SEQ ID NO: 11384 - DNA, 201 bp, Artificial Sequence; identical to SEQ ID NO: 10738
  Synthetic polynucleotide

SEQ ID NO: 11385 - DNA, 201 bp, Artificial Sequence
  Synthetic polynucleotide
tcagcttctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagt

SEQ ID NO: 11386 - DNA, 201 bp, Artificial Sequence
  Synthetic polynucleotide
tctgcttttattttatggttgggataaggctggattattctgagtccaagctaggcccttttgctaatcatgttcatacctcttatcttcctcccacagctcctgggcaacgtgctggtctgtgtgctggcccatcactttggcaaagaattcaccccaccagtgcaggctgcctatcagaaagtggtggctggtgtggct

SEQ ID NO: 11387 - DNA, 201 bp, Artificial Sequence
  Synthetic polynucleotide
tcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccggg

SEQ ID NO: 11388 - DNA, 201 bp, Artificial Sequence
  Synthetic polynucleotide
ccattgaaactgtgatgctcttctaccctgggctgctcctaacctgtgcccttctctgtccagtcccggcagcagagcccatcgagtatgcccagttccctttctacctcaacggcttgcgggacacctcagactttgtggaggcaattgaaaaagtaaggaccatctgcagcaactatacgagcctggggctgtccagtt

SEQ ID NO: 11389 - DNA, 201 bp, Artificial Sequence
  Synthetic polynucleotide
agctgggcgtgtggagcggccccgtggtaatctctcttctaccactttttcatgccttgcagcactttgcccatagggaggaaggggaagtgccccagctcgctgtacatggcctggctggagaccctgtcccaggacctcagacctccagtcatcctgatccgaggaaaccaggaaaacgtgctcaccttttactgccag

SEQ ID NO: 11390 - DNA, 201 bp, Artificial Sequence; identical to SEQ ID NO: 10875
  Synthetic polynucleotide

SEQ ID NO: 11391 - DNA, 201 bp, Artificial Sequence
  Synthetic polynucleotide
tgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggc

SEQ ID NO: 11392 - DNA, 201 bp, Artificial Sequence
  Synthetic polynucleotide
gagtgcatctccgacttcctggacaagcatcagatgaaacacaagaagctgcccctgggcttcaccttctcctttcctgtgaggcacgaagacatcgataaggtgggccgggtggaggggcagaaggcagatgaggggaggcacaggcaccccagaggaactctgccttcaaatgtagcccccataccatgtgctcagaag

SEQ ID NO: 11393 - DNA, 201 bp, Artificial Sequence
  Synthetic polynucleotide
acctgtcggtggattgtgtgttctgtcctcattgtattgaattgcttgctctctttctcagttaacttaccaagactggttacacctggagctggaaattcaacctgaagctgatgctctttcagatactgaacggtaagtgttgaaaagagctaccctggccaggcatgatggctcacacctataatcccagcactttgg

SEQ ID NO: 11394 - DNA, 201 bp, Artificial Sequence; identical to SEQ ID NO: 11095
  Synthetic polynucleotide

SEQ ID NO: 11395 - DNA, 204 bp, Artificial Sequence
  Synthetic polynucleotide
atgtttattttctttcacatccaatgacaaggccttatctctgtctcacctcacagcccccacctctgctcccaaggacttgacagtcattactagggaagggaagcctcgtgccgtcattgtgagttggcagcctcccttggaagccaatgggaaaattactggtaagcatctccactttctctcccagcatagctctccctt

SEQ ID NO: 11396 - DNA, 201 bp, Artificial Sequence
  Synthetic polynucleotide
gctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggta

SEQ ID NO: 11397 - DNA, 201 bp, Artificial Sequence; identical to SEQ ID NO: 11153
  Synthetic polynucleotide

SEQ ID NO: 11398 - DNA, 201 bp, Artificial Sequence
  Synthetic polynucleotide
gggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaa

SEQ ID NO: 11399 - DNA, 208 bp, Artificial Sequence; identical to SEQ ID NO: 10853
  Synthetic polynucleotide

SEQ ID NO: 11400 - DNA, 201 bp, Artificial Sequence
  Synthetic polynucleotide
ggggagcctgggtctcaccctataccacccgcatgcagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggc

SEQ ID NO: 11401 - DNA, 201 bp, Artificial Sequence
  Synthetic polynucleotide
tgcggagatgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagcc

SEQ ID NO: 11402 - DNA, 201 bp, Artificial Sequence
  Synthetic polynucleotide
tatttttctttgtcagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataag

SEQ ID NO: 11403 - DNA, 206 bp, Artificial Sequence
  Synthetic polynucleotide
ccccagcttttaggaaagccatggtcccttgggcagtatacctcctctctccatggcctctttgttcataacgagggtgtattcataaatgcccccaagcacagcctctgtgatgtagtgggtcccaaaatcacggaagagatctctgtattccccgtagctgtactccaggggcagccgcttaactctctgaaggaactcgtaat

SEQ ID NO: 11404 - DNA, 201 bp, Artificial Sequence
  Synthetic polynucleotide
gccttgtgtcgcagacggtgaccagtgcttggtcttgcccttggagcacccgtgcgccagcctgtgctgcgggcacggcacgtgcatcgacggcatcggcagcttcagctgcgactgccgcagcggctgggagggccgcttctgccagcgcggtgagggggagaggtggatgctggcgggcggcggggcggggctggggcc

SEQ ID NO: 11405 - DNA, 201 bp, Artificial Sequence
  Synthetic polynucleotide
gacgtgacggcgtccgcgcttcagggtctgcacatcgcggtccacgagtgtcagcaccagctgcgcgaccagcgctggaactgctccgcgcttgagggcggcggccgcctgccgcaccacagcgccatcctcaagcgcggtgagcctggctgggcgggtcggcgctgccgcggaggctagggggtgggcggcagggcgagg

SEQ ID NO: 11406 - DNA, 201 bp, Artificial Sequence; identical to SEQ ID NO: 11287
  Synthetic polynucleotide

SEQ ID NO: 11407 - DNA, 201 bp, Artificial Sequence
  Synthetic polynucleotide
tgtccaggtaggccccaacagtttctcttgtctggcaggtcttctattactccacgagcatcttcgagaaggcgggggtgcagcagcctgtgtatgccaccattggctccggtatcgtcaacacggccttcactgtcgtgtcggtgagtctttgcttactggcccccccagccaaaccccagggaggaggcagtgccatct

SEQ ID NO: 11408 - DNA, 201 bp, Artificial Sequence
  Synthetic polynucleotide
tttcttaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaa

SEQ ID NO: 11409 - DNA, 201 bp, Artificial Sequence
  Synthetic polynucleotide
ggcaatttttctttccgagtttatgatttcccaagaataaattaccatgtgccattcatccttcatcccacgcaggctccatcgaagactggtgcccacctacgagagcgcgtccatccgccgattccaggagggacgcgtggacaacatcagatcggccactccagaggcactggcttttgtgagagccgtgactgacca

SEQ ID NO: 11410 - DNA, 211 bp, Artificial Sequence
  Synthetic polynucleotide
ccaaggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatttaggtg

SEQ ID NO: 11411 - DNA, 201 bp, Artificial Sequence; identical to SEQ ID NO: 10791
  Synthetic polynucleotide

SEQ ID NO: 11412 - DNA, 201 bp, Artificial Sequence
  Synthetic polynucleotide
ccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgct

SEQ ID NO: 11413 - DNA, 201 bp, Artificial Sequence; identical to SEQ ID NO: 10907
  Synthetic polynucleotide

SEQ ID NO: 11414 - DNA, 213 bp, Artificial Sequence; identical to SEQ ID NO: 10774
  Synthetic polynucleotide

SEQ ID NO: 11415 - DNA, 201 bp, Artificial Sequence
  Synthetic polynucleotide
acccccactgagaggggaggccaggctgcccccagctcccccattcaggctctcaactgaaggccaagccccccaagaagccggagagcagcgcagagcagcagcgccttccactcgggaacggtgagcggggcccagtgggagcgcctcccttctccctggccaggggcaaggggtcaggggtcagagcagggcctgccc

SEQ ID NO: 11416 - DNA, 201 bp, Artificial Sequence
  Synthetic polynucleotide
atccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagac

SEQ ID NO: 11417 - DNA, 201 bp, Artificial Sequence
  Synthetic polynucleotide
ttccagccgcgggccttccacgcgctctgcctgggcagcggcgggctccgcttggcgctgggccttctgcagctgctgcccggccgccggcccgcgggccccgggtcccccgcgacgtccccgccggcctcggtccgcatcctgcgcgctgccgctgcctgcgaccttctcggctgcctgggtaagggcgcgcgcggcccg

SEQ ID NO: 11418 - DNA, 203 bp, Artificial Sequence
  Synthetic polynucleotide
tgctggaagccttcaaaaacattacttccagttccccggaaagacatatttttggagaggacagagttgtctctgagcagcctcaagtgggcacacttgaagaaaggaatgacgtcgtggaagcactgacaggcagtgcagcctcgaggctccgcgggggcacttcctccagacgcctctcttccacaccccttccaaaagca

SEQ ID NO: 11419 - DNA, 201 bp, Artificial Sequence
  Synthetic polynucleotide
agatgtgtccattctccatgtcttcatcagacctcactctgcttgtactccctccctcccaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgg

SEQ ID NO: 11420 - DNA, 201 bp, Artificial Sequence
  Synthetic polynucleotide
aacagatatgctgtttcattatttgctggttaattccttggtttaatttcctcttttagggtgaaattggagctgttggtaacgctggtcctgctggtcccgccggtccccgtggtgaagtgggtcttccaggcctctccggccccgttggacctcctgtaagtagccactgtctttaaactttattgagtaaaagaaaac

SEQ ID NO: 11421 - DNA, 201 bp, Artificial Sequence
  Synthetic polynucleotide
cagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggtaccgacctgccccatccttccttcacctcccttccctcctttccct

SEQ ID NO: 11422 - DNA, 201 bp, Artificial Sequence
  Synthetic polynucleotide
gaaggcacagattcgggccaatggcttcaagctggagacagggcccccgatgggggtgcccccgccgccccctcccgcaccggactacgtgctgcctcccagcctgcatgggcctgagcccaagggcctggccgccggtccacctgctgggccactgggcgactttggggccccagcactgcccatggccgtgcccggtgc

SEQ ID NO: 11423 - DNA, 201 bp, Artificial Sequence; identical to SEQ ID NO: 11177
  Synthetic polynucleotide

SEQ ID NO: 11424 - DNA, 201 bp, Artificial Sequence
  Synthetic polynucleotide
gggcacacctttcccaccctgctcaggcaatgtccctttctcctttcagtcgggaggcaagatcagctcggcgctgcatttctgccgggccgtgtgccgccgggccgagagacggtaagagggctggagagagggagagggcccaagggagagggagaggaacaagggggaggggggagggagagggagaggaggacggag

SEQ ID NO: 11425 - DNA, 201 bp, Artificial Sequence; identical to SEQ ID NO: 11143
  Synthetic polynucleotide

SEQ ID NO: 11426 - DNA, 201 bp, Artificial Sequence
  Synthetic polynucleotide
ctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtcc

SEQ ID NO: 11427 - DNA, 201 bp, Artificial Sequence; identical to SEQ ID NO: 10873
  Synthetic polynucleotide

SEQ ID NO: 11428 - DNA, 201 bp, Artificial Sequence
  Synthetic polynucleotide
tgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctg

SEQ ID NO: 11429 - DNA, 201 bp, Artificial Sequence
  Synthetic polynucleotide
acgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctg

SEQ ID NO: 11430 - DNA, 201 bp, Artificial Sequence
  Synthetic polynucleotide
ccctgagcaatggcggctgccagtatctgtgcctccctgccccgcagatcaacccccactcgcccaagtttacctgcgcctgcccggacggcatgctgctggccagggacatgaggagctgcctcacaggtgtggcacacgccttgtttctgcgtcctgtgtcctccaactgccccctcctgagcctctctctgctcatct

SEQ ID NO: 11431 - DNA, 201 bp, Artificial Sequence
  Synthetic polynucleotide
gcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctg

SEQ ID NO: 11432 - DNA, 201 bp, Artificial Sequence
  Synthetic polynucleotide
atgagaaaactactatgacttctaaattacgaaaaaatgttaaaaagtcataatgtttttcttttcaggacatgtgaacttatatatttgacacaacccagcagttcgtaagtagttcacagaatgttatttttcacttaaaaaaaaagatttttatggaataatctcaaacatcttgatagttagggttagtttgatcga

SEQ ID NO: 11433 - DNA, 201 bp, Artificial Sequence
  Synthetic polynucleotide
gatatattttcacctttccctcccactggcagaaaaccctactcagtcaccatggtgttcacagtatcgcagacagctactgaagtccctaccagagttaagtgcctctgcagagttgtgtatagaagacagaccaatgcctaagttggaaattgagaaggaaattgaattaggtaagtaccattgaactcatgtcctctg

SEQ ID NO: 11434 - DNA, 201 bp, Artificial Sequence
  Synthetic polynucleotide
cgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggc

SEQ ID NO: 11435 - DNA, 201 bp, Artificial Sequence
  Synthetic polynucleotide
ttcctccttcctcttccctcctccctctgcagtttcttagcgaggttgggctgttcatcatgtctggactatttcacgacccaggggctgaccaccatctatcagattgagcattactccatggatgtaagtaactgttagacttttctcaaattttatttcttcatttctttcctctgatgacaaccgccttgtagttca

SEQ ID NO: 11436 - DNA, 203 bp, Artificial Sequence
  Synthetic polynucleotide
accctaatgtaaaagtccccctgcgagtttccagcacggatctgaaaggcattgtaggcaccggggtagacggaggtcgcctggatctggaacacgtcagcgggcacgctccgctccgaggtgatggtcatgtagcggtgcacaatggatgaaggctgctctcgacatagagggttggaggccgggcagagacagcggctaga

SEQ ID NO: 11437 - DNA, 201 bp, Artificial Sequence
  Synthetic polynucleotide
tcttgtgggtgtaaacggctttcaaccccaacctgtccagaggcctctggatcagtttgtgctgcagtcgcacgcatggttcaacgtgtcctccctcccctatgcggtgcccccgctcagcctgccccgaggggaagctcaggtgagtgtggggggatggagcagagaccagtcctgcaggacccattgtcccccagtcag

SEQ ID NO: 11438 - DNA, 201 bp, Artificial Sequence; identical to SEQ ID NO: 10757
  Synthetic polynucleotide

SEQ ID NO: 11439 - DNA, 208 bp, Artificial Sequence
  Synthetic polynucleotide
cgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgag

SEQ ID NO: 11440 - DNA, 201 bp, Artificial Sequence
  Synthetic polynucleotide
gggggagtccctggagggcccgggccgcgctgacctcgcgtccctccgcaggagattccccggagcacgctggactcgttcatgcagccgttccagagcacactgtggctgctggtggggctgtcggtgcacgtggtggccgtgatgctgtacctgctggaccgcttcaggtgagcgcgacccggggctcagacacctcca

SEQ ID NO: 11441 - DNA, 201 bp, Artificial Sequence
  Synthetic polynucleotide
cccacaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagtgagagccactccccagt

SEQ ID NO: 11442 - DNA, 201 bp, Artificial Sequence
  Synthetic polynucleotide
cttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaagcccctctaccgccccggggtccattttgcag

SEQ ID NO: 11443 - DNA, 201 bp, Artificial Sequence
  Synthetic polynucleotide
gaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggcca

SEQ ID NO: 11444 - DNA, 201 bp, Artificial Sequence
  Synthetic polynucleotide
gcacgcgtgcctgcctggcagcccctcacccaggtgctccctgcaggtcctgcctgactacctgaagggactcttcagcagtgtgccggccagccggcccagcgagcagctgctgcagcaggtgtccaagctggcttcactgcagcatcgcgccaaggaccacttctacctgccgagcgtgtgagcatctgccctcctgcc

SEQ ID NO: 11445 - DNA, 201 bp, Artificial Sequence
  Synthetic polynucleotide
cactctggctcccaccttttcggcttcccacccacgccacccaaagaagtgtctcctgaccctagcaccacgggggctgcgtctccagcctcatcttccgcggggggtagtgcagcccgaggagaggacaaggacggcgtcaagtaccaggtgtcactgacggagagcatgaagatggaaagtggcagtcccctgcgccca

SEQ ID NO: 11446 - DNA, 201 bp, Artificial Sequence
  Synthetic polynucleotide
tggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaagga

SEQ ID NO: 11447 - DNA, 201 bp, Artificial Sequence; identical to SEQ ID NO: 11417
  Synthetic polynucleotide

SEQ ID NO: 11448 - DNA, 201 bp, Artificial Sequence
  Synthetic polynucleotide
tctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgcca

SEQ ID NO: 11449 - DNA, 201 bp, Artificial Sequence
  Synthetic polynucleotide
aacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttat

SEQ ID NO: 11450 - DNA, 201 bp, Artificial Sequence
  Synthetic polynucleotide
agtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacc

SEQ ID NO: 11451 - DNA, 201 bp, Artificial Sequence; identical to SEQ ID NO: 11287
  Synthetic polynucleotide

SEQ ID NO: 11452 - DNA, 201 bp, Artificial Sequence
  Synthetic polynucleotide
ggaatccccaagtagttagtgttgcattgtctgctgccgtccagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtca

SEQ ID NO: 11453 - DNA, 201 bp, Artificial Sequence
  Synthetic polynucleotide
tgtgcagccacaaagcagagcctcagatgctagcttccgcctctgtctctagggtccagaaggccctgtcctgacgcctcctctcctcgcaggagtctgactggaaggtgctgaagctggttctgggcaggctgcctgagtccctgcgctataaagtgctcatctttacttccccttgcagtgtggaccagctgtgctctg

SEQ ID NO: 11454 - DNA, 201 bp, Artificial Sequence
  Synthetic polynucleotide
tcaaataggatcatggacttcttggaggagccaatccctggtgtagggacctatgatgatttcaatacaattgattgggtgagagagaagtctcgagaccgggataggcaccgagaggtaagacaaaagatggcacatgggtaagtgttaggaaatacaggggaagaaattgaagatacatattctttctattctttcctt

SEQ ID NO: 11455 - DNA, 205 bp, Artificial Sequence
  Synthetic polynucleotide
gtgtggagaggagatgggaaagttgcgggggacctgggaggcggctgaccccaaggtatgtgcaggactgccaagcggggctgaactttgcagacgaggacgaggcccaggccttccgggccctcgtgcaggagaagatacaaaaaaggaatcagaggcaaagtggaggtgaggaggccacaggggaggaaaggaagttgggcag

SEQ ID NO: 11456 - DNA, 202 bp, Artificial Sequence
  Synthetic polynucleotide
ggacacagctgggaagccagttgggggttgggggagtgccccaggcagggcccacccgtctccctgggctaactcccctgcctcacccatacccccacagtaccctggcgtggcccagagcatcaacagtgatgtcaacaacctcatggccgtgttgaacatgagcaacatgcttccagaaggtctgaggctaggtggttgg

SEQ ID NO: 11457 - DNA, 201 bp, Artificial Sequence
  Synthetic polynucleotide
ctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggc

SEQ ID NO: 11458 - DNA, 201 bp, Artificial Sequence
  Synthetic polynucleotide
cggcgggggcgacggcgcgggttgtggcggccgcaggccgggccctgcgaggcctcagctaccgcagcctgcggcggcgcgtgcggcggctgcggcggcttacggcccgcgaggcggccaccgcagtggcggcgctgctctgggcagcagtgacgcgcgctggggccgctggcgcgggggcggcggcgggcgcgctgggcc

SEQ ID NO: 11459 - DNA, 201 bp, Artificial Sequence
  Synthetic polynucleotide
aacaacggcggctgttcccacgtctgcaatgaccttaagatcggctacgagtgcctgtgccccgacggcttccagctggtggcccagcgaagatgcgaaggtgatttccgggtgggactgagccctgggccccctctgcgcttcctgacatggcaaccaaacccctcatgcctcagtttccccatctgttaagtgtgcttg

SEQ ID NO: 11460 - DNA, 203 bp, Artificial Sequence
  Synthetic polynucleotide
tccatcatgtatgcgacaaggaggctaaccccatgctcttgttccctcaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggc

SEQ ID NO: 11461 - DNA, 201 bp, Artificial Sequence; identical to SEQ ID NO: 10852
  Synthetic polynucleotide

SEQ ID NO: 11462 - DNA, 201 bp, Artificial Sequence
  Synthetic polynucleotide
cccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggc

SEQ ID NO: 11463 - DNA, 201 bp, Artificial Sequence
  Synthetic polynucleotide
cgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccg

SEQ ID NO: 11464 - DNA, 203 bp, Artificial Sequence
  Synthetic polynucleotide
tctccatcccctgctgcgggggaccgcgcaagcgcagtgagtactgcacgttgtcgcgggccagtaacgtcatcagacgtgtgtgtgtccctgcggcgctaagaaggggagactgaggctgaggctggggaacatcgggcagcatgagcggctgcgggctcttcctgcgcaccacggctgcggctcgtgcctgccggggtctg

SEQ ID NO: 11465 - DNA, 201 bp, Artificial Sequence
  Synthetic polynucleotide
gggaagagctgtggcctccgcaacctcctactcacttccgctccgttctcttgcccgccctgcagcggcacccgacctgacagcgttcagcgacccgcgccagttccccgcgctgccctccatctccgacccccgcatgcactatccaggcgccttcacctactccccgacgccggtcacctcgggcatcggcatcggcat

SEQ ID NO: 11466 - DNA, 201 bp, Artificial Sequence
  Synthetic polynucleotide
cccactcctaggtttctggtgagcttcatggttgacgcccggggtggttccatgagaggaagtcgccacaacggcctgcgagtggtgatcccgccacggacgtgcgcagcgcccacccgcatcacctgccgcctggtcaagccccagaagctcagcacgccgcccccactggccgaggaggagggcctggccagcaggatc

SEQ ID NO: 11467 - DNA, 202 bp, Artificial Sequence
  Synthetic polynucleotide
ggtcctgaccttggctggggggcaccccctgggtgtaagtggtggttttcttgagcgtgtactggcgcccgcaggcctcatcctcctccatgatgcccttgctgctgacggagggcacgcaggtgttggcgcccgagtggatacccgagtcgtaggtgtatgtctgctgccactcagtcaccttgataggctgctccatcag

SEQ ID NO: 11468 - DNA, 205 bp, Artificial Sequence
  Synthetic polynucleotide
aggtccctgtcccccggcccccacaccggctcccccaacgccaggagaaaagccattgcctccagggatggggatgaagcctgtccctcctgggccatagccattgccattgccacttggggcaaagccatttcccccagtgcctccaggtctggaaccagcactccctggaattcctcccattggaagtccatccatgcaaagt

SEQ ID NO: 11469 - DNA, 201 bp, Artificial Sequence
  Synthetic polynucleotide
gtgtcttccaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatggtgagttc

SEQ ID NO: 11470 - DNA, 204 bp, Artificial Sequence
  Synthetic polynucleotide
gaaaagggccccagagggttcccgcctcaaaacctcggaggcaccgtgctgaggagggccgcgggcgggtccactggcccagcgccgcctcacttcctgggcccggcccagcccacgtcaccaaagggaccctcgccggtggccgagcgtggcgggggcccgcacggggtacagaggtcggagtcggtgtctgactctccctcc

SEQ ID NO: 11471 - DNA, 201 bp, Artificial Sequence
  Synthetic polynucleotide
gagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagg

SEQ ID NO: 11472 - DNA, 201 bp, Artificial Sequence
  Synthetic polynucleotide
tacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccg

SEQ ID NO: 11473 - DNA, 200 bp, Artificial Sequence
  Synthetic polynucleotide
tccgcccccgtagccgccgccggagcttccgccgccggagcttccgcctccgtagccgccgccggaactgccgccgtggccgccgccgtggccgccgccggagcttccgccgccggagcttccgccgccgtagccgccgccgaaacttccgccgccgcgtccgccgcctccggaactaaacggggtgaggtcacattcgg

SEQ ID NO: 11474 - DNA, 201 bp, Artificial Sequence
  Synthetic polynucleotide
gtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctg

SEQ ID NO: 11475 - DNA, 201 bp, Artificial Sequence; identical to SEQ ID NO: 11279
  Synthetic polynucleotide

SEQ ID NO: 11476 - DNA, 205 bp, Artificial Sequence
  Synthetic polynucleotide
tccccatcccctcctcacttctgcctcacagtggccaggtcctgtgccagattgtccctctcaacctccagccgggcgctgttggcggtgagttgatcgagccgcagccgcagctctcgcagctcagcctggtagacgtctgccagcttggtgggctccttggcccgcagctggttcagctcagcagccagcgccttgttttgct

SEQ ID NO: 11477 - DNA, 210 bp, Artificial Sequence
  Synthetic polynucleotide
cgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggg

SEQ ID NO: 11478 - DNA, 201 bp, Artificial Sequence; identical to SEQ ID NO: 11103
  Synthetic polynucleotide

SEQ ID NO: 11479 - DNA, 201 bp, Artificial Sequence
  Synthetic polynucleotide
tgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctct

SEQ ID NO: 11480 - DNA, 201 bp, Artificial Sequence
  Synthetic polynucleotide
caaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctca

SEQ ID NO: 11481 - DNA, 201 bp, Artificial Sequence
  Synthetic polynucleotide
agctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctccca

SEQ ID NO: 11482 - DNA, 201 bp, Artificial Sequence; identical to SEQ ID NO: 10825
  Synthetic polynucleotide

SEQ ID NO: 11483 - DNA, 201 bp, Artificial Sequence
  Synthetic polynucleotide
gtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgct

SEQ ID NO: 11484 - DNA, 201 bp, Artificial Sequence
  Synthetic polynucleotide
ttgtatgatattagaattcaggtgcggggcctccccagtttgggcgggactcacactcttttgcccaatagggtgatgttgggagtgcaggactaaagggtgacaaggtgagtgtgggcatggggagggcagggcaggggccagggtgctcccgactcctctgattcctgcctgccccctcagggagactcagctgtgatc

SEQ ID NO: 11485 - DNA, 201 bp, Artificial Sequence
  Synthetic polynucleotide
agtagcaggttttcttttcaggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtggg

SEQ ID NO: 11486 - DNA, 201 bp, Artificial Sequence
  Synthetic polynucleotide
gcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagc

SEQ ID NO: 11487 - DNA, 208 bp, Artificial Sequence
  Synthetic polynucleotide
cagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcac

SEQ ID NO: 11488 - DNA, 201 bp, Artificial Sequence
  Synthetic polynucleotide
agtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgc

SEQ ID NO: 11489 - DNA, 201 bp, Artificial Sequence
  Synthetic polynucleotide
ctgtggccctgagcaatggcctggtgctggcggccctagctcggcggggccggcggggccactgggcacccatacacgtcttcattggccacttgtgcctggccgacctggccgtggctctgttccaagtgctgccccagctggcctggaaggccaccgaccgcttccgtgggccagatgccctgtgtcgggccgtgaagt

SEQ ID NO: 11490 - DNA, 201 bp, Artificial Sequence
  Synthetic polynucleotide
cacagagtttgctagccctggagctgcctccatccctgttcccaggcccagagaaatcccagttggtttctggggaggccacggtggctgagctggatggactggagccagatactgagtatacggtgcatgtgagggcccatgtggctggcgtggatgggccccctgcctctgtggttgtgaggactggtgagtggaccc

SEQ ID NO: 11491 - DNA, 202 bp, Artificial Sequence
  Synthetic polynucleotide
gtgatgacgatggacagggtgacgaagatcatggtgaacagcaggtactcgccgatgagtgggatgaccagtgaggtggacgggatgatctcggtgatgagcagcaggaagacggtgagcgacagcagcacggagatgcacagcgtgatcttctcgccacactcggagggcaggtagaagaccagcacggtgaggcaggaga

SEQ ID NO: 11492 - DNA, 201 bp, Artificial Sequence
  Synthetic polynucleotide
tgacttttcccttgcttctctttttcaccttcccacagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgt

SEQ ID NO: 11493 - DNA, 201 bp, Artificial Sequence
  Synthetic polynucleotide
cgaggcccaggaggtggggcagcttctgcagcagcacatggagtgcgccattgggcaggcgctgctggtgcatgcacggaatgcagccaccaagagccgggccaaggacagggatgacttcaaggtatgcactgacctctgtccctggggacaccgagggcaagaatgttcagggtagggtccatgcctgggtctgctcct

SEQ ID NO: 11494 - DNA, 201 bp, Artificial Sequence
  Synthetic polynucleotide
cccctcctccaccctcgccccctcctctctgttctcctcccctctctgaggcccattctctgtttcccacagacacggagcagccaggggaggtgtcggccttggggccgggccgggcgggggcagggccgagtagccggggccggccgggggggccgtggggggagagcccgtccagtggcccctccagccctgagagca

SEQ ID NO: 11495 - DNA, 201 bp, Artificial Sequence
  Synthetic polynucleotide
acccaaattcttggagttgatgttgactgtggaattctaatgtgcttggctcttagggtatgactggtttccctggtgctgctggacggactggtcccccaggaccctctgtaagtaaatcactgtaaacgtgtcttcatttactctagccaaaaggcctggcttctgataggaaactggtaagaaactcttcatgaaaac

SEQ ID NO: 11496 - DNA, 201 bp, Artificial Sequence
  Synthetic polynucleotide
cagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccacctt

SEQ ID NO: 11497 - DNA, 201 bp, Artificial Sequence; identical to SEQ ID NO: 11030
  Synthetic polynucleotide

SEQ ID NO: 11498 - DNA, 201 bp, Artificial Sequence
  Synthetic polynucleotide
cggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggac

SEQ ID NO: 11499 - DNA, 201 bp, Artificial Sequence; identical to SEQ ID NO: 11233
  Synthetic polynucleotide

SEQ ID NO: 11500 - DNA, 201 bp, Artificial Sequence
  Synthetic polynucleotide
gcacgggccgcgcacgcagcgccgcgctgccgcgcagatcgcgcaggcactgctgggcgccgaggagcgcaaagtggaaatcgccttctaccggaaagatggtaggagcgggccggggcggggccacgaccaggggcggggtcaagaggggcgggaccacggcgaggggcagggtgcgtgggggtgtgggggtgtgggggc

SEQ ID NO: 11501 - DNA, 201 bp, Artificial Sequence
  Synthetic polynucleotide
gagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccatgtccagagtctgggttctcttggtttgt

SEQ ID NO: 11502 - DNA, 201 bp, Artificial Sequence
  Synthetic polynucleotide
atactgtctgtccccacaggtggtctccgtgggcatcaaagacgtgtttgacttcatcccaggctcagaccagctcaatgtcatttcttgccaaggcctggcaccatcccagggccggcccggcctctcgctggtcaaggagaactatgcagagctgctggaggatgccttcctgaagaatgtcaccgcccagatctgcat

SEQ ID NO: 11503 - DNA, 203 bp, Artificial Sequence
  Synthetic polynucleotide
gctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggccccca

SEQ ID NO: 11504 - DNA, 201 bp, Artificial Sequence
  Synthetic polynucleotide
ctggtggtcttccgcatcgtgctgacggctgtgggcggcgaggccatctactcggacgagcaggccaagttcacttgcaacacgcggcagccaggctgcgacaacgtctgctatgacgccttcgcgcccctgtcgcacgtgcgcttctgggtcttccagattgtggtcatctccacgccctcggtcatgtacctgggctac

SEQ ID NO: 11505 - DNA, 201 bp, Artificial Sequence
  Synthetic polynucleotide
ctgtctcacacagattccacccccgttttccgttgctccaggatctgcggcggaaagcggcccggctggtggccgccaagtgcacactggcagcccgtgtggacagtttccacgagagcacagaagggaaggtgaggagggaaaggtgaggggcggccgggcgtcttttcctctgggcctggggtgtctctgcagggagac

SEQ ID NO: 11506 - DNA, 201 bp, Artificial Sequence
  Synthetic polynucleotide
ggggtcgttctgggagctgtgatcgggggtgtcctcggggtggtgctgttgctgctgctgcttttctacgtggttcggtactgctggctacgcaggcaggcggccctgcagaggaggctcaggtaaggggcggagcctagctcccctccccctctccccactatcccccatctgggcggagactactccagtgggtgggag

SEQ ID NO: 11507 - DNA, 201 bp, Artificial Sequence
  Synthetic polynucleotide
ggacgcacgggcatggggaccccggggagccagatggcccccgtgagcctgaatgtgccccgacccaaccaggtgagcgggcccgtcatgcccagcatgcctcccgggcagtggcagcaggcgccccttccccagcagcagcccatgccaggcttgcccaggcctgtgatatccatgcaggcccaggcggccgtggctggg

SEQ ID NO: 11508 - DNA, 201 bp, Artificial Sequence
  Synthetic polynucleotide
ggagaggtggtgcccttgggaggtcttgggcaggggtgggatataactggggggcccagctgattccctccccttccactccaggcctggcctccacgcaggcacagagtgtgccggtcatcaacagcatgggcagcagcctgaccaccctgcagcccgtccagttctcccagccgctgcacccctcctaccagcagccgc

SEQ ID NO: 11509 - DNA, 201 bp, Artificial Sequence
  Synthetic polynucleotide
agcaattatagatcagtttggtcagagaataatctctgagcatttcctcgtggaggacagttactttcctgagaacatgtgctcacgtgtgcaatacaggtaaggccccctccacccattagcaagcgaaggtaattttattgacattcctgtgtaattctgttcttcaagtaacatgcaaataaatgccaaaccaaagat

SEQ ID NO: 11510 - DNA, 202 bp, Artificial Sequence
  Synthetic polynucleotide
tgtgccaccagacagcatacctggttccgcaggtcctggcttaggccctggcactggtccagggggacccctccagccagctccatgcccagcacccgtgtcgtgcacagctccttaaccacggctgggacccggaagaaggggtcatttgccagcagctgcctggggcagaaggaaagggaggaaggggacttcgtgcttc

SEQ ID NO: 11511 - DNA, 201 bp, Artificial Sequence
  Synthetic polynucleotide
ccttgcccgctccggggctgctcgcgatccccacgaccacgtgcctctcctctcccgcaggccgcgccaagaccttccgcctgaagctgcccgcgctgctggcgctgacggcccgggagtcgtcggtgcggtcgggcggcgcgggcggcgcgggcgccccgggggccgtggtggtggacgtggacctgacgcccgcggcac

SEQ ID NO: 11512 - DNA, 201 bp, Artificial Sequence
  Synthetic polynucleotide
gggccctaggggattttaagcaggttccaggaaccccccgttcagttcctggtcccccactttctcaaccccacagatgctccgggcccctgcccctgccccagctatggctcctggggctccctcatccagccccagccctatcctggctgtgctgctcttctcttctttgggtaagtggagccactctactctgggagt

SEQ ID NO: 11513 - DNA, 201 bp, Artificial Sequence
  Synthetic polynucleotide
gacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctc

SEQ ID NO: 11514 - DNA, 201 bp, Artificial Sequence
  Synthetic polynucleotide
ggcaccgaaggcgcccgaggcgacgctgggtccgtgctggggctgttcgtgcggctctgatcccggggtgggcagagcggggcttccgggtgggcggcccgtggcactcctgtaccgctgctgcttttgtggtgaagaccacccgcggcagggcagcatcctctacagcttgctcactagctcaaagcaaacgcacgtggc

SEQ ID NO: 11515 - DNA, 201 bp, Artificial Sequence
  Synthetic polynucleotide
cccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagc

SEQ ID NO: 11516 - DNA, 205 bp, Artificial Sequence
  Synthetic polynucleotide
ccagggctcccgcgggcccagccggcaggacgcggcctcccccgctcctccagcccgcggccgcggcggtactcacagacctgttctgcagccgccgccgccgctgccgccatcttcccgcgcccgccgccgccgagctccccgcccgactgtgcccgcccctccgcgaccgcaccctgcgcgcctgcgcttgcgccctggcggg

SEQ ID NO: 11517 - DNA, 201 bp, Artificial Sequence
  Synthetic polynucleotide
ctccccgcagcccgctagacgagccgatggcgcggccccggagagcccgggagccgctgctcgtggcgctgctgccgctggcgtggctggcgcaggcgggcctggcgcgcgcggcgggctctgtgcgcctggcgggcggcctgacgctgggcggcctgttcccggtgcacgcgcggggcgcggcgggccgggcgtgcgggc

SEQ ID NO: 11518 - DNA, 201 bp, Artificial Sequence; identical to SEQ ID NO: 10951
  Synthetic polynucleotide

SEQ ID NO: 11519 - DNA, 201 bp, Artificial Sequence
  Synthetic polynucleotide
cgctgctcatccttgcctctagctgcctattgctcgtggggctttgttgctggcccgccccgatcagaggtgcaatgctgggttttggcaggagctgctggcactgctgaagtgtgtggaggctgagattgcaaactatgaggcgtgcctcaaggaggaggtagagaagaggaagaagttcaaggtgggtgatttctccag

SEQ ID NO: 11520 - DNA, 201 bp, Artificial Sequence
  Synthetic polynucleotide
ccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcataga

SEQ ID NO: 11521 - DNA, 201 bp, Artificial Sequence
  Synthetic polynucleotide
ctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctc

SEQ ID NO: 11522 - DNA, 202 bp, Artificial Sequence
  Synthetic polynucleotide
gggggctgaaggggagtaaaaaagagcccagggaggtggctggggcgggaggaatggatagaggggtgaggagagggagagaaactgacacagaaaagagagaggagagaggtttggggcaggggagagaagccagccagagtgggggcggcaggagatagtggagggggtgggggccaaggtggggccacaggaagagagg

SEQ ID NO: 11523 - DNA, 201 bp, Artificial Sequence; identical to SEQ ID NO: 11480
  Synthetic polynucleotide

SEQ ID NO: 11524 - DNA, 201 bp, Artificial Sequence
  Synthetic polynucleotide
ccaagccccgagggtgacccgcgcttcagcttcctcctccacttctacacagtacccatacccaaaaccggcaccctcagctgcacggtagccctgcgtcccaagaccgggtctcaagaccaggtgagtggggcctgggccggccccagcttcaagtgggagcttccaggtctgtggtttgcaggaagggacatggcagcc

SEQ ID NO: 11525 - DNA, 201 bp, Artificial Sequence
  Synthetic polynucleotide
ccccctcctctctgttctcctcccctctctgaggcccattctctgtttcccacagacacggagcagccaggggaggtgtcggccttggggccgggccgggcgggggcagggccgagtagccggggccggccgggggggccgtggggggagagcccgtccagtggcccctccagccctgagagcagtgaggatgagggccca

SEQ ID NO: 11526 - DNA, 201 bp, Artificial Sequence
  Synthetic polynucleotide
tgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcg

SEQ ID NO: 11527 - DNA, 201 bp, Artificial Sequence
  Synthetic polynucleotide
tgcccggggtgcccggcgcggtcctgaccctctgcctctggctggcggcctccagcggctgcctggcggccggccccggcgcggctgctgcgcggcggctggacgagtcgctgtctgccgggagcgtccagcgcgctcgctgcgcctccaggtgcctgagcctgcagatcactcgcatctccgccttcttccagcacttcc

SEQ ID NO: 11528 - DNA, 201 bp, Artificial Sequence
  Synthetic polynucleotide
tattttggacagatatcatcaacgaagccattttcagtgccaaccgcctcacaggttccgatgtcaacttgttggctgaaaacctactgtccccagaggatatggttctcttccacaacctcacccagccaagaggtaagggtgggtcagccccacccccccaaccttgaaacctccttgtggaaactctggaatgttctg

SEQ ID NO: 11529 - DNA, 201 bp, Artificial Sequence
  Synthetic polynucleotide
tccccagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacat

SEQ ID NO: 11530 - DNA, 201 bp, Artificial Sequence
  Synthetic polynucleotide
gtgactggctgaggcggcgccagttggccgggcacggggctgctgtaaggccgaggttgcggcggaagcggagaccatgttccgagcggcggctccggggcagctccggcgggcggtgagtccggactgggaaggcgaacccagggacggccccccgtcaacccgccgtccctatggggtcttgcaaagatcactggcccc

SEQ ID NO: 11531 - DNA, 201 bp, Artificial Sequence
  Synthetic polynucleotide
caacgaggagaaggcgcagcgtgaggccaacaaaaagatcgagaagcagctgcagaaggacaagcaggtctaccgggccacgcaccgcctgctgctgctgggtaagggcgggcggggggcgccggccccggcccgggggccctcgaagggcgccccgcaggccgcgcgcgccgagcccgccccccgccccgggcgcgcgct

SEQ ID NO: 11532 - DNA, 201 bp, Artificial Sequence
  Synthetic polynucleotide
gtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatgggtaagcagggtagggggggctgcattgatggagtag

SEQ ID NO: 11533 - DNA, 201 bp, Artificial Sequence
  Synthetic polynucleotide
tgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgc

SEQ ID NO: 11534 - DNA, 201 bp, Artificial Sequence
  Synthetic polynucleotide
gagtgccaggcccccaagggtcatctccacaaaagaatgcagggggcacagccctcatggtcccattgttccccggccaggtgaactgtgtggtgatgcgaggccttaacgaggatgaactcctggactttgcggccttgactgagggcctccccctggatgtgcgcttcatagagtatatgccctttgatggtcagtgac

SEQ ID NO: 11535 - DNA, 201 bp, Artificial Sequence
  Synthetic polynucleotide
acaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggcctggcgggaatgggttgcggccgccgggggtgccccagaaggaacct

SEQ ID NO: 11536 - DNA, 201 bp, Artificial Sequence
  Synthetic polynucleotide
cagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtccaggtcctgg

SEQ ID NO: 11537 - DNA, 201 bp, Artificial Sequence
  Synthetic polynucleotide
gtccccccagcgaacccacccacctggcagtagaggacgtctctgacaccacggtctccctcaagtggcggcccccagagcgcgtgggagcaggaggcctggatggctacagcgtggagtactgcccagagggctgtgagtgtccccgcccccaacccccctccccaaaggaagaacatgctcaccttgccattgagcaga

SEQ ID NO: 11538 - DNA, 201 bp, Artificial Sequence
  Synthetic polynucleotide
tgtctgagaacatgctgtgtgcgggcatcctcggggaccggcaggatgcctgcgagggcgacagtggggggcccatggtcgcctccttccacggcacctggttcctggtgggcctggtgagctggggtgagggctgtgggctccttcacaactacggcgtttacaccaaagtcagccgctacctcgactggatccatgggc

SEQ ID NO: 11539 - DNA, 201 bp, Artificial Sequence
  Synthetic polynucleotide
ccccgcgttccggacgcgggggaacgcgaacaccgtgtgggtggactaccccaatattgtccgggtcgtgccggtggggggccgcatctacattgacgacgggctcatctccctagtggtccagaaaatcggtgcggacgcgcctcccgccctgaccacatccgtgcgctgggcacattcccttctccttggctcccccat

SEQ ID NO: 11540 - DNA, 201 bp, Artificial Sequence
  Synthetic polynucleotide
ggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctca

SEQ ID NO: 11541 - DNA, 201 bp, Artificial Sequence
  Synthetic polynucleotide
ttgacgagcagagtggaaaggagaagtacaagcttctggtggaaggtgataacctgcgggcagtcatggccacacacggtgtgaagggcacccgaaccacctccaataacacctatgaggtaccactcagcccacggggtcgccttagggttaggctgtcttccttgtgccatctgcaggccttccactgattcccagtat

SEQ ID NO: 11542 - DNA, 201 bp, Artificial Sequence; identical to SEQ ID NO: 11131
  Synthetic polynucleotide

SEQ ID NO: 11543 - DNA, 201 bp, Artificial Sequence
  Synthetic polynucleotide
tcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcct

SEQ ID NO: 11544 - DNA, 201 bp, Artificial Sequence
  Synthetic polynucleotide
ctctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttgg

SEQ ID NO: 11545 - DNA, 201 bp, Artificial Sequence
  Synthetic polynucleotide
cagggggatgaggattggtgtccagattcacaacacctggctgaatcctgatgtggtcaccacttacctacgggagaagcaccagatccgagtccgagcccagaggcttccagaagtacaggtctgtgtctctttccagtcccatggagctgaactctggaaggaataaagtcccatgtagcaggagcactgactgggagt

SEQ ID NO: 11546 - DNA, 201 bp, Artificial Sequence
  Synthetic polynucleotide
aacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagacc

SEQ ID NO: 11547 - DNA, 201 bp, Artificial Sequence
  Synthetic polynucleotide
gaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctatt

SEQ ID NO: 11548 - DNA, 205 bp, Artificial Sequence
  Synthetic polynucleotide
cggctcctgggacactggatggggcaggcacagcccctcccatcgctgccgtccgtccccccagggcgccgagaccaggaagcgctcgcccacacttagcagccagttcaagcggtcactggagctgctgatgcgcacgctgggtgcctgccagcccttctttgtgcgatgcatcaagcccaatgagttcaagaagcccatggtg

SEQ ID NO: 11549 - DNA, 201 bp, Artificial Sequence
  Synthetic polynucleotide
ggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgct

SEQ ID NO: 11550 - DNA, 201 bp, Artificial Sequence
  Synthetic polynucleotide
catgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtatgcggggcccatggcctctagcctggccatgtgctcctatgtggggct

SEQ ID NO: 11551 - DNA, 201 bp, Artificial Sequence
  Synthetic polynucleotide
agggagctgtagctggatgctccctgctccccacaggcatcgtgaaggcctactacgtgcgtgcccgggctcacgcagaggtgtggaatgaggccgaggccaaggcggacctccagaaagtgctggagctggagccgtccatgcagaaggcggtgcgcagggagctgaggctgctggagaaccgcatggcggagaagcagg

SEQ ID NO: 11552 - DNA, 208 bp, Artificial Sequence; identical to SEQ ID NO: 10853
  Synthetic polynucleotide

SEQ ID NO: 11553 - DNA, 201 bp, Artificial Sequence
  Synthetic polynucleotide
gccctgatgggcagctgggtcgccagattagccacttcttctcggagaatgaggatttccgctgcattgctggcatgtgtgtggatgctcgtggtgatctcatcgtggctgacagtagtcgcaaggaaattctccattttcctaagggtgggggctatagtgtccttattcgagagggacttacctgtccggtgggcatag

SEQ ID NO: 11554 - DNA, 201 bp, Artificial Sequence
  Synthetic polynucleotide
tgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggc

SEQ ID NO: 11555 - DNA, 201 bp, Artificial Sequence
  Synthetic polynucleotide
ggcccttctcagctggttccagccagctggcctctgcctaactcactcccctctctcctgacccacagcccagcacggccccacccaagcccaagccgcctccgctgaccaaggagacagtggtgttctgggacatgcgcctgtggcacgtggtgggcatcttttcgctcttcgtgttgtccatcagtgagtagctgttcc

SEQ ID NO: 11556 - DNA, 201 bp, Artificial Sequence
  Synthetic polynucleotide
tttccctcagcctggacccccgcagccccatctcttcagcacacccaccctgggctcctcggcctggcctgatcttctcatcccctaacaggccgcgccgacttcctggagcagccggtgctgggcttcgtgaggctgcaggaggcagcggagctggaggcggtggagctgccggtgcctatacgcttcctctttgtgttg

SEQ ID NO: 11557 - DNA, 201 bp, Artificial Sequence; identical to SEQ ID NO: 11213
  Synthetic polynucleotide

SEQ ID NO: 11558 - DNA, 201 bp, Artificial Sequence
  Synthetic polynucleotide
gttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttccc

SEQ ID NO: 11559 - DNA, 201 bp, Artificial Sequence
  Synthetic polynucleotide
caggaccgcttgcagttcgagactgtggaagtctcggagcccagcatgctgcagaagatcctcaccaccaggcggcgggagaccgggggcaacgagccactgcccgtgcccacgctgcagcaccatttggcaccgccggcggaggccaggaaggtgccctccgcctcccaggtccaagccatcaagtgctttctttccaaa

SEQ ID NO: 11560 - DNA, 201 bp, Artificial Sequence
  Synthetic polynucleotide
tcacgctgcgcctcgagttcccggcggccggccgcgccctggccgccctcagcgtccgcccctttgcgctgcgccgcctcagcgcgggcctctcgctgcctctgctcacctcggtacgcccgtccccggccagaccccgcgcctcccaccggcagcgtcccgccccctcgcggggccccgccccggcagcgtctcacccct

SEQ ID NO: 11561 - DNA, 201 bp, Artificial Sequence
  Synthetic polynucleotide
gcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggcc

SEQ ID NO: 11562 - DNA, 201 bp, Artificial Sequence
  Synthetic polynucleotide
ccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttccct

SEQ ID NO: 11563 - DNA, 201 bp, Artificial Sequence
  Synthetic polynucleotide
caggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaaggg

SEQ ID NO: 11564 - DNA, 201 bp, Artificial Sequence
  Synthetic polynucleotide
tacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaa

SEQ ID NO: 11565 - DNA, 201 bp, Artificial Sequence
  Synthetic polynucleotide
cccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccct

SEQ ID NO: 11566 - DNA, 201 bp, Artificial Sequence
  Synthetic polynucleotide
gttctgtgaccccttttcctcatctctgcctgcttcctcacagcttgaggcagccctaggtgaggccaagaagcaacttcaggatgagatgctgcggcgggtggatgctgagaacaggctgcagaccatgaaggaggaactggacttccagaagaacatctacagtgaggtggggactgtgctttgcaagccagagggctg

SEQ ID NO: 11567 - DNA, 201 bp, Artificial Sequence
  Synthetic polynucleotide
gagcctgccgggaggaagctccctggaaaccagcccccgcctcttccaggggtggttggggggaccctccaggcggccaccatctgtgcctccagccaccagtttctctccacacactacaacctgcacaacctctacggcctgaccgaagccatcgcctcccacaggtgagggccacgtcccgccccactgggctctgcc

SEQ ID NO: 11568 - DNA, 201 bp, Artificial Sequence
  Synthetic polynucleotide
tctggggggacagtcggggccgccagtaccaggagctccctcgatgccccgcccccacccccagcctcctcaacatccccctctccagcccgggtcggcggccccggggcgacgtggagagcaggctggatgccctccagcgccagctcaacaggtgagggagtgcaggtggggtgggggggcacgccctggagtctggtc

SEQ ID NO: 11569 - DNA, 201 bp, Artificial Sequence
  Synthetic polynucleotide
ggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagc

SEQ ID NO: 11570 - DNA, 201 bp, Artificial Sequence
  Synthetic polynucleotide
atggtgattctaggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaagtatgttattagagggtggacctggaga

SEQ ID NO: 11571 - DNA, 201 bp, Artificial Sequence; identical to SEQ ID NO: 11023
  Synthetic polynucleotide

SEQ ID NO: 11572 - DNA, 201 bp, Artificial Sequence
  Synthetic polynucleotide
tgcagcccggggggtgtccgggctgagcgggctcacccggttgttgtggcgcgcctgctccagagtggcggtgaagaggaagcagcggcaggggacgcccgcggctcgggcacactggacgtacctgtgggggaaggagctggatgtgcaggccccgcccaccccgccgcaggccacctacggccccgcggtcacgctacc

SEQ ID NO: 11573 - DNA, 201 bp, Artificial Sequence
  Synthetic polynucleotide
gtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgc

SEQ ID NO: 11574 - DNA, 201 bp, Artificial Sequence
  Synthetic polynucleotide
ctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatttaggtgccgaagtggatttccaacaacatgccaagaaag

SEQ ID NO: 11575 - DNA, 201 bp, Artificial Sequence
  Synthetic polynucleotide
cctcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgcccta

SEQ ID NO: 11576 - DNA, 201 bp, Artificial Sequence
  Synthetic polynucleotide
cacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgc

SEQ ID NO: 11577 - DNA, 20 bp, Artificial Sequence
  Synthetic
tgcgaagatggctcggaggc

SEQ ID NO: 11578 - DNA, 20 bp, Artificial Sequence
  Synthetic
gcaaggacaaatctgacagg

SEQ ID NO: 11579 - DNA, 20 bp, Artificial Sequence
  Synthetic
tcctcgtcacatttgtcctg

SEQ ID NO: 11580 - DNA, 20 bp, Artificial Sequence
  Synthetic
ctgcaaggacaaatctgagg

SEQ ID NO: 11581 - DNA, 20 bp, Artificial Sequence
  Synthetic
tttcctcgtgagatttgtcg

SEQ ID NO: 11582 - DNA, 20 bp, Artificial Sequence
  Synthetic
acatctactcgctggtgagc

SEQ ID NO: 11583 - DNA, 20 bp, Artificial Sequence
  Synthetic
ctgtccctggcttttatccc

SEQ ID NO: 11584 - DNA, 20 bp, Artificial Sequence
  Synthetic
agctgcagaaggtgactgca

SEQ ID NO: 11585 - DNA, 20 bp, Artificial Sequence
  Synthetic
ctgcagaaggtgactgcaga

SEQ ID NO: 11586 - DNA, 20 bp, Artificial Sequence
  Synthetic
tgtgaactatggtgcatata

SEQ ID NO: 11587 - DNA, 20 bp, Artificial Sequence
  Synthetic
cagcaggggaggcccccagc

SEQ ID NO: 11588 - DNA, 20 bp, Artificial Sequence
  Synthetic
tttttccatataagataaga

SEQ ID NO: 11589 - DNA, 10 bp, Artificial Sequence
  Synthetic
tgcacgtact

SEQ ID NO: 11590 - DNA, 20 bp, Artificial Sequence
  Synthetic
ataatttctattatattaca

SEQ ID NO: 11591 - DNA, 24 bp, Artificial Sequence
  Synthetic
tgtacaaggaccgacaagggtagg

What is claimed is:

1. A method of introducing a genetic change into a target genomic location encoding a pathogenic allele to modify the pathogenic allele to become a non-pathogenic allele using a Cas-based double strand break genome editing system, the method comprising:
using a computer hardware processor to perform:
selecting a guide RNA for use in introducing the genetic change into the target genomic location by analyzing inputs indicating a nucleotide sequence of the target genomic location and one or more available cut sites for the Cas-based double strand break genome editing system, the selecting comprising:
(a) determining a microhomology score matrix using a first neural network, the determining comprising:
determining a plurality of pairs of overhang sequences using the inputs;
determining a microhomology length vector and/or a microhomology GC fraction vector using the inputs; and
applying the first neural network to the plurality of pairs of overhang sequences and the microhomology length vector and/or the microhomology GC fraction vector to obtain the microhomology score matrix;
(b) determining a microhomology-independent score matrix using a second neural network, the determining comprising:
determining a deletion length vector using the inputs and the plurality of pairs of overhang sequences; and
applying the second neural network to the deletion length vector to obtain the microhomology-independent score matrix;
(c) determining a probability distribution over 1-bp insertions;
(d) determining, using the microhomology score matrix, the microhomology-independent score matrix and the probability distribution over 1-bp insertion, a probability distribution over indel genotypes and a probability distribution over indel lengths for the nucleotide sequence of the target genomic location and the one or more available cut sites;
(e) determining, using the probability distribution over indel genotypes and the probability distribution over indel lengths, for each guide RNA of a plurality of guide RNAs, a predicted frequency of introducing the genetic change into the target genomic location using the Cas-based double strand break genome editing system and the guide RNA;
(f) selecting, using the predicted frequencies of (e), a guide RNA of the plurality of guide RNAs for use in introducing the genetic change into the target genomic location using the Cas-based double strand break genome editing system; and
introducing the genetic change into the target genomic location using the guide RNA selected at (f) and the Cas-based double strand break genome editing system, wherein the genetic change is a 1 base pair insertion or a 1–60 base pair deletion that modifies the pathogenic allele to become the non-pathogenic allele.

2. The method of claim 1, wherein analyzing inputs comprises identifying, for a cut site of the one or more available cut sites, a plurality of pairs of overhang sequences, each pair of the plurality of pairs of overhang sequences comprising:
(i) a 3'-overhang sequence; and
(ii) a 5'-overhang sequence.

3. The method of claim 1, wherein determining the probability distribution over 1-bp insertion comprises:
determining, using the inputs, an overall deletion score, a precision score, and/or cut site nucleotides; and
applying a third neural network to the overall deletion score, the precision score, and/or the cut site nucleotides to obtain the probability distribution over 1-bp insertion.

4. The method of claim 1, comprising:
contacting a plurality of cells with the guide RNA and the Cas-based double strand break genome editing system; and
introducing, using the selected guide RNA and the Cas-based double strand break genome editing system, the genetic change into the target genomic location of at least 30% of cells of the plurality of cells.

5. The method of claim 1, comprising:
contacting a plurality of cells with the guide RNA and the Cas-based double strand break genome editing system; and
introducing, using the selected guide RNA and the Cas-based double strand break genome editing system, the genetic change into the target genomic location of at least 50% of cells of the plurality of cells.

6. The method of claim 1, wherein the Cas-based double strand break genome editing system comprises a type II Cas RNA-guided endonuclease, or a functional variant or ortholog thereof.

7. The method of claim 1, wherein the Cas-based double strand break genome editing system comprises a Cas9 RNA-guided endonuclease, or a variant or orthologue thereof.

8. The method of claim 7, wherein the Cas9 RNA-guided endonuclease is *Streptococcus pyogenes* Cas9 (SpCas9), *Staphylococcus pyogenes* Cas9 (SpCas9), *Staphyloccocus aureus* Cas (SaCas9), *Francisella novicida* Cas9 (FnCas9), or a functional variant or orthologue thereof.

9. The method of claim 1, further comprising:
treating a genetic disease in a subject caused by a pathogenic allele in a genome of a cell of the subject by contacting the genome of the cell of the subject with the selected guide RNA and the Cas-based double strand break genome editing system, in order to correct the pathogenic allele into a non-pathogenic allele in the genome of the cell.

10. The method of claim 1, wherein selecting the guide RNA for use in introducing the genetic change into the target genomic location using the Cas-based double strand break genome editing system comprises selecting a guide RNA that corresponds to a cut site of the target genomic location.

11. The method of claim 1, wherein selecting the guide RNA comprises selecting a guide RNA that has a predicted frequency of introducing the genetic change into the target genomic location of at least 30%.

12. The method of claim 1, wherein selecting the guide RNA comprises selecting a guide RNA that has a predicted frequency of introducing the genetic change into the target genomic location of at least 50%.

13. The method of claim 1, wherein the genetic change is a 1 base pair insertion or a 1-60 base pair deletion that modifies the pathogenic allele to become a wildtype allele.

* * * * *